United States Patent
Gepstein

(10) Patent No.: US 10,106,812 B2
(45) Date of Patent: Oct. 23, 2018

(54) NUCLEIC ACID CONSTRUCT FOR INCREASING ABIOTIC STRESS TOLERANCE IN PLANTS

(75) Inventor: Shimon Gepstein, Haifa (IL)

(73) Assignee: Technion Research & Development Foundation Limited, Haifa (IL)

( * ) Notice: Subject to any disclaimer, the term of this patent is extended or adjusted under 35 U.S.C. 154(b) by 926 days.

(21) Appl. No.: 13/810,246

(22) PCT Filed: Jul. 14, 2011

(86) PCT No.: PCT/IB2011/053150
§ 371 (c)(1),
(2), (4) Date: Jan. 15, 2013

(87) PCT Pub. No.: WO2012/007919
PCT Pub. Date: Jan. 19, 2012

(65) Prior Publication Data
US 2013/0198906 A1    Aug. 1, 2013

Related U.S. Application Data

(60) Provisional application No. 61/364,407, filed on Jul. 15, 2010.

(51) Int. Cl.
C12N 15/82 (2006.01)
C12N 15/113 (2010.01)

(52) U.S. Cl.
CPC ........ *C12N 15/8273* (2013.01); *C12N 15/113* (2013.01); *C12N 15/8237* (2013.01); *C12N 15/8261* (2013.01); *C12N 15/8271* (2013.01); *C12N 15/8295* (2013.01); *Y02A 40/146* (2018.01)

(58) Field of Classification Search
None
See application file for complete search history.

(56) References Cited

U.S. PATENT DOCUMENTS

| 7,227,055 B2 * | 6/2007 | Spangenberg et al. ....... 800/298 |
| 2006/0010515 A1 | 1/2006 | He |
| 2008/0229450 A1 | 9/2008 | McAvoy et al. |

FOREIGN PATENT DOCUMENTS

| CN | 101146439 | 3/2008 |
| WO | WO 02/16655 | 2/2002 |
| WO | WO 2006/102559 | 9/2006 |
| WO | WO 2012/007919 | 1/2012 |

OTHER PUBLICATIONS

Merewitz et al. Effects of SAG12-ipt and HSP18.2-ipt expression on cytokinin production, root growth, and leaf senescence in creeping bentgrass exposed to drought stress. J. Amer. Soc. Hort. Sci. 2010. 135(3): 230-239.*
Noh et al. Identification of a promoter region responsible for the senescence-specific expression of SAG12. Plant Molecular Biology. 1999. 41: 181-194.*
Xu et al. Effects of SAG12-ipt expression on cytokinin production, growth and senescence of creeping bentgrass (*Agrostis stolonifera* L.) under heat stress. Plant Growth REgul. 2009. 57: 281-291.*
Lu et al. The GUS reporter-aided analysis of the promoter activities of a rice metallothionein gene reveals different regulatory regiosn responsible for tissue-specific and inducile expression in transgenic *Arabidopsis*. Transgenic Research. 2007. 16: 177-191.*
Guo et al. Characterization of the *Arabidopsis* metallothionein gene family: tissue-specific expression and induction during senescence and in response to copper. New Phytologist. 2003. 159: 369-381.*
GenBanK Accession No. NM_111773.3. *Arabidopsis thaliana* MT2A (Metallothionein 2A). Published Jun. 19, 2009. pp. 1-2.*
Zhu et al. *Arabidopsis thaliana* Metallothionein, AtMT2a, Mediates ROS Balance during Oxidative Stress. Journal of Plant Biology. 2009. 52: 585.*
Notification of Office Action dated Dec. 6, 2013 From the State Intellectual Property Office of the People's Republic of China Re. Application No. 201180044363.X and Its Translation Into English.
Search Report dated Dec. 6, 2013 From the State Intellectual Property Office of the People's Republic of China Re. Application No. 201180044363.X and Its Translation Into English.
Communication Pursuant to Article 94(3) EPC dated Jan. 3, 2014 From the European Patent Office Re. Application No. 11749521.8.
Notification of Office Action dated Jun. 18, 2014 From the State Intellectual Property Office of the People's Republic of China Re. Application No. 201180044363.X and Its Translation Into English.
Notification of Office Action dated Jan. 8, 2015 From the State Intellectual Property Office of the People's Republic of China Re. Application No. 201180044363.X and Its Translation Into English.
Communication Pursuant to Article 94(3) EPC dated Jun. 12, 2015 From the European Patent Office Re. Application No. 11749521.8.
International Preliminary Report on Patentability dated Jan. 24, 2013 From the International Bureau of WIPO Re. Application No. PCT/IB2011/053150.
Communication Relating to the Results of the Partial International Search dated Dec. 9, 2011 From the International Searching Authority Re. Application No. PCT/IB2011/053150.
International Search Report and the Written Opinion dated Feb. 13, 2012 From the International Searching Authority Re. Application No. PCT/IB2011/053150.
Arnon et al. "The Essentiality of Certain Elements in Minute Quantity for Plants With Special Reference to Copper", Plant Physiology, 14(2): 371-375, Apr. 1939.

(Continued)

*Primary Examiner* — Ashley Kate Buran

(57) ABSTRACT

Provided are nucleic acid constructs which comprise a polynucleotide encoding adenosine phosphate-isopentenyl-transferase (IPT) operably linked to a stress-related promoter. Also provided are host cells transformed with the nucleic acid constructs, transgenic plants expressing the IPT coding sequence under the transcriptional regulation of a stress-related promoter and methods of using same for increasing abiotic stress tolerance of a plant, and biomass of plants under stress or normal conditions.

11 Claims, 22 Drawing Sheets
(21 of 22 Drawing Sheet(s) Filed in Color)
Specification includes a Sequence Listing.

(56) References Cited

OTHER PUBLICATIONS

Baligar et al. "Nutrient Use Efficiency in Plants", Communications in Soil Science and Plant Analysis, 32(7&8): 921-950, 2001.
Binns "Cytokinin Accumulation and Action: Biochemical, Genetic, and Molecular Approaches", Annual Review of Plant Physiology and Plant Molecular Biology, 45: 173-196, 1994.
Binyamin et al. "The Early Light-Induced Protein Is Also Produced During Leaf Senescence of Nicotiana Tabacum", Planta, 212: 591-597, 2001.
Brault et al. "Mechanisms of Cytokinin Action", Plant Physiology et Biochemistry, 37(5): 403-412, 1999.
Buchanan-Wollaston "Isolation of cDNA Clones for Genes That Are Expressed During Leaf Senescence in Brassica napus. Identifiaction of a Gene Encoding a Senescence-Specific Metallothionein-Like Protein", Plant Physiology, 105: 839-846, 1994.
Buchanan-Wollaston "The Molecular Biology of Leaf Senescence", Journal of Experimental Botany, 48(307): 181-199, Feb. 1997.
Buchanan-Wollaston et al. "Leaf Senescence in Brassica napus: Cloning of Senescence Related Genes by Subtractive Hybridisation", Plant Molecular Biology, 33: 821-834, 1997.
Buchanan-Wollaston et al. "The Molecular Analysis of Leaf Senescence—A Genomics Approach", Plant Biotechnology Journal, 1: 3-22, 2003.
Clement et al. "Identification of New Up-Regulated Genes Under Drought Stress in Soybean Nodules", Gene, 426: 15-22, 2008.
Cowan et al. "Effects of Senescence-Induced Aleration in Cytokinin Metabolism on Source-Sink Relationship and Ontogenic and Stress-Induced Transitions in Tobacco", Planta, XP019344312, 221(6): 801-814, Aug. 1, 2005. Abstract, Fig.5.
Davies et al. "Identification of cDNA Clones for Tomato (Lycopersicon esculentum Mill.) mRNAs That Accumulate During Fruit Ripening and Leaf Senescnece in Response to Ethylene", Planta, 179: 73-80, 1989.
Epstein "Silicon", Annual Review of Plant Physiology and Plant Molecular Biology, 50: 641-664, 1999.
Fageria et al. "Phosphorus-Use Efficiency in Wheat Genotypus", Journal of Plant Nutrition, 22(2): 331-340, 1999.
Fageria et al. "Response of Upland Rice Genotypes to Soil Acidity", The Red Soil of China, p. 219-235, 2004.
Gepstein et al. "A New Strategy for Engineering Drought Tolerance in Plants Via Auto-Regulated Expression of a Key Enzyme of Cytokinin Biosynthesis", Parallel Session 09: Stress and Acclimation, Abiotic, FESPB 2008, XVI Congress of the Federation of European Societies of Plant Biology (FESPB), Tampere, Finland, Aug. 17-22, 2008, XP055010646, Abstract # S09-09, Aug. 17, 2008. Abstract S09-09.
Gepstein et al. "Large-Scale Identification of Leaf Senescence-Associated Genes", The Plant Journal, 36: 629-642, 2003.
Grattan et al. "Salinity—Mineral Nutrient Relations in Horticultural Crops", Scientia Horticulturae, 78: 127-157, 1999.
Guo et al. "Transcriptome of Arabidopsis Leaf Senescence", Plant, Cell and Environment, 27: 521-549, 2004.
Guterman et al. "Senescence-Associated mRNAs That May Participate in Signal Transduction and Protein Trafficking", Physiologia Plantarum, 118: 439-446, 2003.
Hajouj et al. "Cloning and Characterization of a Receptor-Like Protein Kinase Gene Associated With Senescence", Plant Physiology, 124(3): 1305-1314, Nov. 2000.
Hanfrey et al. "Leaf Senescence in Brassica napus: Expression of Genes Encoding Pathogenesis-Related Proteins", Plant Molecular Biology, 30: 597-609, 1996.
Hare et al. "The Molecular Basis of Cytokinin Action", Plant Growth Regulation, 23: 41-78, 1997.
Kasuga et al. "Improving Plant Drought, Salt, and Freezing Tolerance by Gene Transfer of a Single Stress-Inducible Transcription Factor", Nature Biotechnology, 17: 287-291, Mar. 1999.
Ko et al. "Motif X (CACACGTGGG) and Motif Y (CACACGTATC) of the DcECP31 Promoter Have Different Functions in the ABA-Response Pathway", Journal of Plant Physiology, XP009030292, 159(10): 1159-1161, Oct. 1, 2002. Abstract.
Lohman et al. "Molecular Analysis of Natural Leaf Senescence in Arabidopsis thaliana", Physiologia Plantarum, 92: 322-328, 1994.
Marcotte Jr. et al. "Abscisic Acid-Responsive Sequences From the Em Gene of Wheat", The Plant Cell, 1: 969-976, Oct. 1989.
Merewitz et al. "Effects of SAG12-Ipt and HSP18.2-Ipt Expression on Cytokinin Production, Root Growth, and Leaf Senescence in Creeping Bentgrass Exposed to Drought Stress", Journal of the American Society for Horticultural Science, XP009153455, 135(3): 230-239, May 1, 2010. Abstract, p. 237, col. 2, Para 11-14.
Miyawaki et al. "Expression of Cytokinin Biosynthetic Isopentenyltransferase Genes in Arabidopsis: Tissue Specificity and Regulation by Auxin, Cytokinin, and Nitrate", The Plant Journal, 37: 128-138, 2004.
Mok et al. "Cytokinin Metabolism and Action", Annual Reviews in Plant Physiology and Plant Molecular Biology, 52: 89-118, 2001.
Mollier et al. "Maize Root System Growth and Development as Influenced by Phosphorus Deficiency", Journal of Experimental Botany, 50(333): 487-497, Apr. 1999.
Noodén et al. "Correlative Controls of Senescence and Plant Death in Arabidopsis thaliana (Brassicaceae)". Journal of Experimental Botany, 52(364): 2151-2159, Nov. 2001.
Noodén et al. "Senescence Mechanisms", Physiologia Plantarum, 101: 746-753, 1997.
Pieters et al. "Low Sink Demand Limits Photosynthesis Under Pi Deficiency", Journal of Experimental Botany, 52(358): 1083-1091, May 2001.
Quirino et al. "Diverse Range of Gene Activity During Arabidopsis thaliana Leaf Senescence Includes Pathogen-Independent Induction of Defense-Related Genes", Plant Molecular Biology, 40: 267-278, 1999.
Rivero et al. "Cytokinin-Dependent Photorespiration and the Protection of Photosynthesis During Water Deficit", Plant Physiology, 150: 1530-1540, Jul. 2009.
Rivero et al. "Delayed Leaf Senescence Induces Extreme Drought Tolerance in a Flowering Plant", Proc. Natl. Acad. Sci. USA, PNAS, 104(49): 19631-19636, Dec. 4, 2007.
Rivero et al. "Delayed Leaf Senescence Induces Extreme Drought Tolerance in a Flowering Plant", Proc. Natl. Acad. Sci. USA, PNAS, XP002499726, 104(49): 19631-19636, Dec. 4, 2007. Abstract.
Rivero et al. "Delayed Leaf Senescence Induces Extreme Drought Tolerance in a Flowering Plant", Proc. Natl. Acad. Sci. USA, XP002499726, 104(49): 19631-19636, Dec. 4, 2007. Abstract.
Rufty Jr. et al. "Alterations in Leaf Carbohydrate Metabolism in Response to Nitrogen Stress", Plant Physiology, 88: 725-730, 1988.
Soudry et al. "Accumulation and Remobilization of Amino Acids During Senescence of Detached and Attached Leaves: In Planta Analysis of Tryptophan Levels by Recombinant Luminescent Bacteria", Journal of Experimental Botany, 56(412): 695-702, Feb. 2005.
Synkova et al. "Photosynthesis of Transgenic Pssu-Ipt Tobacco", Journal of Plant Physiology, XP009153454, 155(2): 173-182, Aug. 1, 1999. Abstract.
Wardlaw "Tansley Review No. 27. The Control of Carbon Partitioning in Plants", New Phytology, 116: 341-381, 1990.
Xue et al. "Cotton Metallothionein GhMT3a, A Reactive Oxygen Species Stavanger, Increased Tolerance Against Abiotic Stress in Transgenic Tobacco and Yeast", Journal of Experimental Botany, 60(1): 339-349, 2009.
Yamaguchi-Shinozaki et al. "A Novel Cis-Acting Element in an Arabidopsis Gene Is Involved in Responsiveness to Drought, Low-Temperature, or High-Salt Stress", The Plant Cell, 6: 251-264, Feb. 1994.
Zhou et al. "Structure, Organization and Expression of the Metallothionein Gene Family in Arabidopsis", Molecular & General Genetics, XP000907576, 248(3): 318-328, Aug. 21, 1995. Abstract.
Communication Pursuant to Article 94(3) EPC dated Jul. 2, 2014 From the European Patent Office Re. Application No. 11749521.8.

* cited by examiner

Nucleic acid sequence of the Metallo promoter-IPT-NOS terminator construct

```
   1 gtacgggcc ccccctcgag gtcgacggta tcgataagct tgatatcgaa ttcctgcagg oggccgcgaa ttcactagtg atgacgatgt ttctgtgatt
 101 gtgattcac ttgaaggaga aattggaag tcttccatgt gaatactaat ctttgaaga gctttgaaga gtctcctact ttagaactga ttcaaatctt
 201 ttgaataga ttttttttt attcgccga ggttttacca ttcgtcact csgcatatt tttgaactc actgcataaa gacttttgt gcattggt cccaatatac
 301 gttattgtta gtgaaaata taatgtaaga ataattata taactatcct actagcaaag ctttttttg cttttttgca gcactttgt tacggtgat
 401 gaaaataaca gacttgaact ttataatact gtagtaatac cgtagtaatac ctaatttttg cttttttgca atatgctgc cactaataa gtcataaatt ttatattttc
 501 ataactata gtatacactc tttgactaaa caaacaaat cggttagca aagaaaaag ttactttcct gatgaaggaat gataaggaat tcggaactga
 601 atttgtgtac gttctctctg gaccaacac actgaaccac actgtaagat ttctcctta cgtaattaat cttttgatca gaacgacaa
 701 aaagaagtc taacaatatc aacaattt ttatagta tttttagata tttttcctgc taatttttatc tagtgtagac aaccaaat ataagattat
 801 tataaaca cgaatacca agtggacgac tgaggttaat agatcagcc gtagataaaa gatctgcatg aaggoogtg agatccaaaa otgaacgga cggtgataag
 901 accataacac acgaactac gtacgctct cgaactagt cctataatt tattttcatt agttgaaaca aactcccacac tattgaaca acatgtatg attgaacga
1001 cgtaagaga tcataaatt tgggagctc gagggggat cttctcttaa tatamanatc agttgtgtt acacaagaga tcttccaatt gagaaata tgaattccc
1101 tctcattag ctataaatt tgggagctc gagggggat cttctcttaa tataaaaatc agttgtgtt acacaagaga tcttccaatt gagaaaaata tgaattccc
1201 gcgoogcca tgggaoggg gaggggggat cttctcttaa tatamanatc agttgtgtt acacaagaga tcttccaatt gagaaaaata atcgaattta
1301 cggtccaact tgcacaggaa agacgacgac cggatagct cgcgatagct cggccacca gacgagget cggccacca gacgagget gctccagg tcaagatcaaac tggctgatgc cggcctcgat actgcagc
1401 ctatcaacg gaagcggacg accaacagtg gaagaactga aaggaacgac grtgcaaccc ctgaagggc aagctagagc gcgatagct ctgatgat atcgcagca
1501 agcagctca tcatggctg atcgcggag tgtataatca tgaggccaag ggoggctta ttcttgaggg aggatcaac tgttgctca actgcatgc
1601 ccgaaacag tattggatg cagatttcg tggcatat ttggcataat attattaaag agttgttta tctttggaat gaaccctgc tgaggocaa ttcatgaag cggccaagc ocgagttag
1701 cagatgtgc accccgtgc aggccattct gctagccaga accaagatcac ggcagatatg ttaagcaag cgtttcaca tatgcaaa tctgaaggt tatgaactcgc atggatggt
1801 atcgatatge catgtgttt ttcatocatg cgccctccaaca gaatagagaat tcccccaag gccagcataa ttaagcataag atcgatctgt cggatggat
1901 tcaggtat tteatccata cagocctgc tcgcaccectg cttcatctgg ataagatgt cagatcagag ggocgactcg aattgatgt tcaaactttt cggaatatgc
2001 tagttacgc cagcctgc tgcccgbct ttcgccgbct cttcatctgg ataagatgtt cagatcagag ggocgactcg aattgatgt tcaaactttt cggaatatgc
2101 tttcttagc ttgaaacctg tccgcaget tggcaattagg tagaaattag tactattctc tccgcaatt catgttttg catgtaatac ttaagcgcc atgagggaag
2201 tatttagc gatcagtta cctcagtaag gtccgccat tatgatga gtccgcaatt atctatt tagcoggata atacgggoga tatcooggg acatgctcca (SEQ ID NO:1)
```

FIG. 2

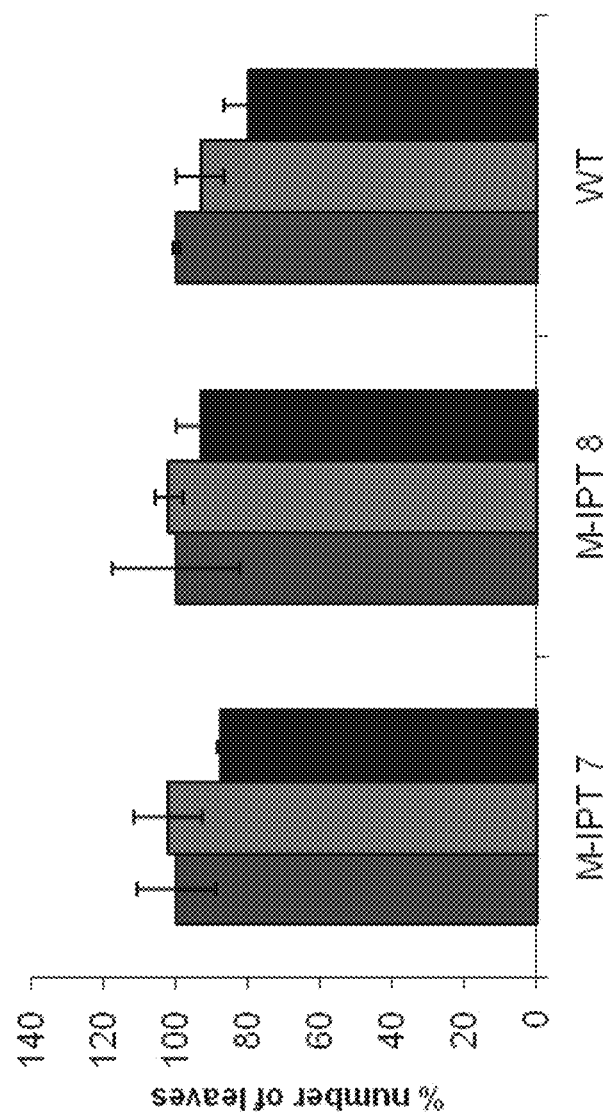

FIG. 5A  400ml
FIG. 5B  200ml
FIG. 5C  100ml

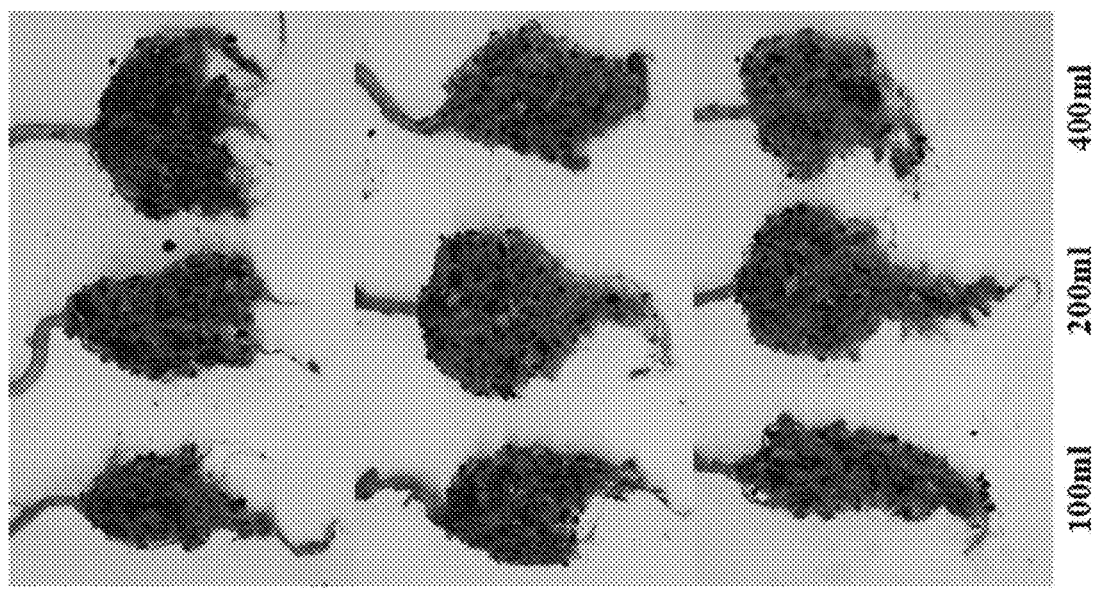
FIG. 6A WT
FIG. 6B M-IPT7
FIG. 6C M-IPT8

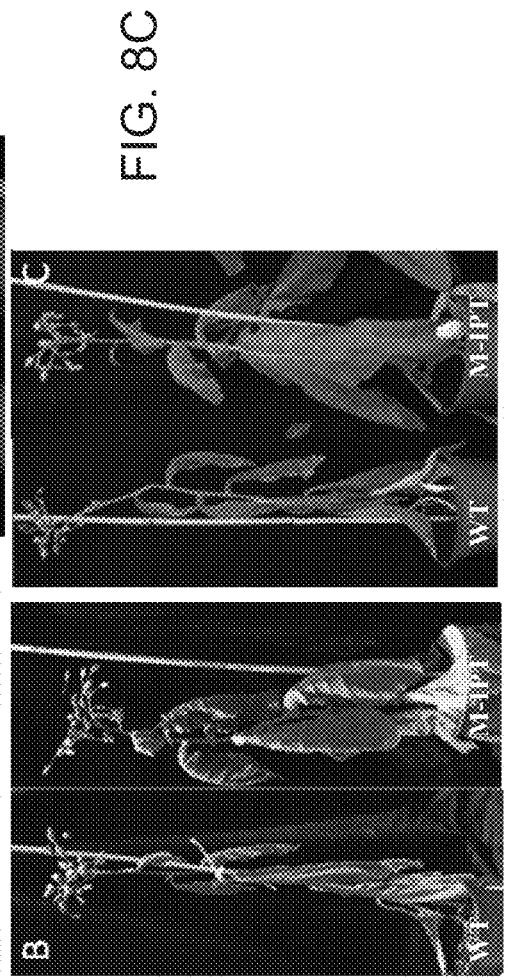
FIG. 8A  FIG. 8B  FIG. 8C  FIG. 8D

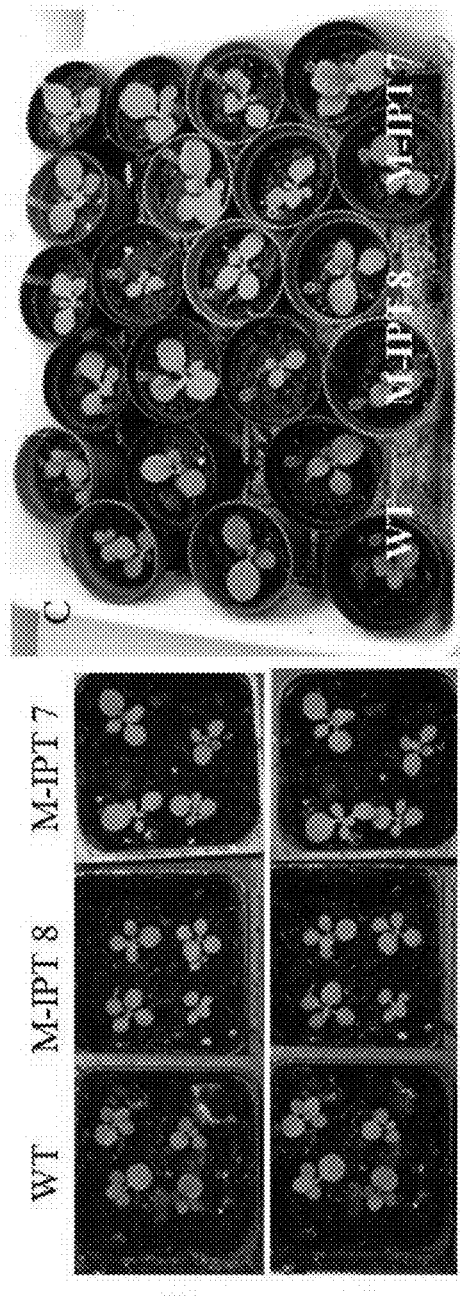
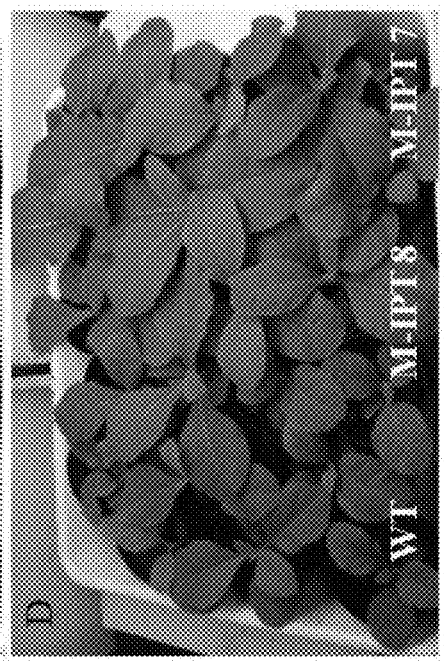
FIG. 11A
FIG. 11B
FIG. 11C
FIG. 11D

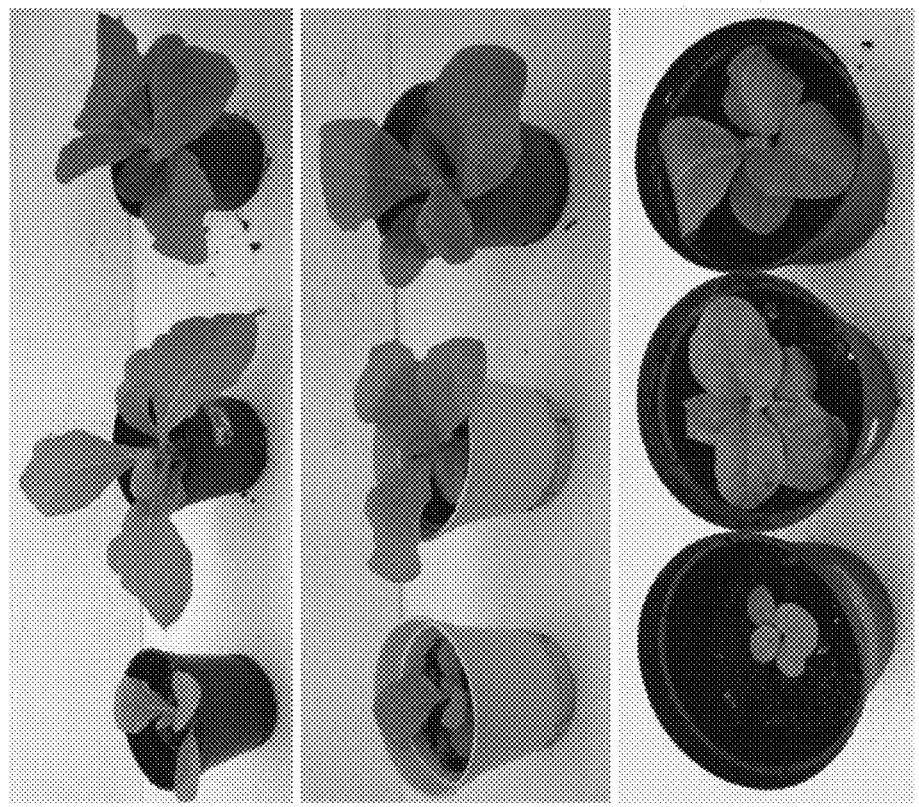

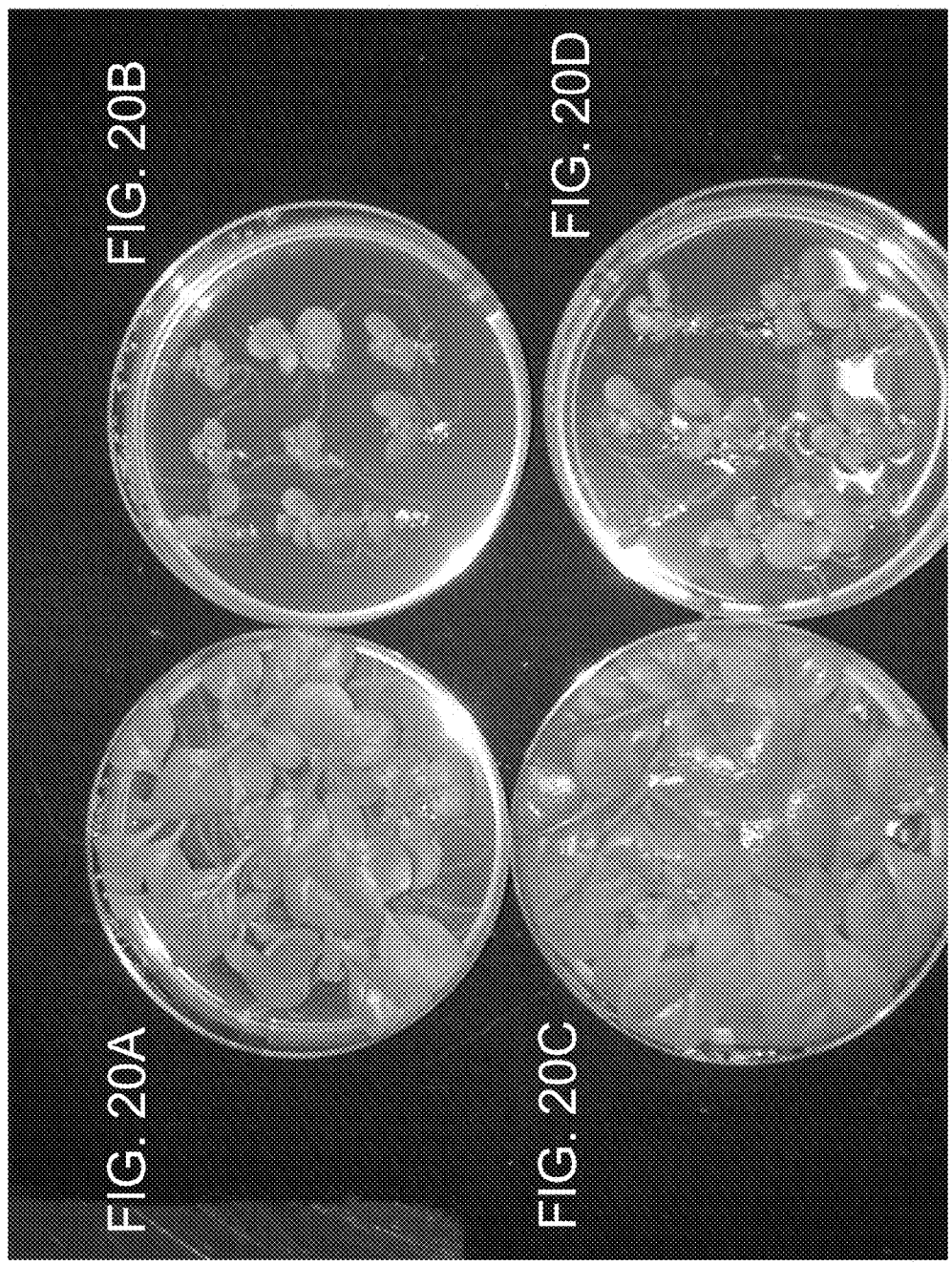

NUCLEIC ACID CONSTRUCT FOR INCREASING ABIOTIC STRESS TOLERANCE IN PLANTS

RELATED APPLICATIONS

This application is a National Phase of PCT Patent Application No. PCT/IB2011/053150 having International filing date of Jul. 14, 2011, which claims the benefit of priority under 35 USC § 119(e) of U.S. Provisional Patent Application No. 61/364,407 filed on Jul. 15, 2010. The contents of the above applications are all incorporated by reference as if fully set forth herein in their entirety.

FIELD AND BACKGROUND OF THE INVENTION

The present invention, in some embodiments thereof, relates to nucleic acid constructs encoding adenosine phosphate-isopentenyltransferase (IPT) under a stress-related promoter and more particularly, but not exclusively, to methods of using same for generating transgenic plants with increased abiotic stress tolerance and increased yield, biomass and growth rate under normal or stress conditions.

Abiotic stress is the primary cause of crop loss worldwide, reducing average yields for most major crop plants by more than 50% and causing losses worth hundreds of million dollars each year. Abiotic stresses lead to a series of morphological, physiological, biochemical and molecular changes that adversely affect plant growth and productivity.

Phenotypic symptoms in response to chilling include induced injury such as leaf expansion, wilting, chlorosis, and necrosis. Chilling also severely hampers the reproductive development of plants and plants may suffer from metabolic dysfunction when chilled.

Freezing conditions cause severe membrane damage, and reactive oxygen species (ROS) produced in response to freeze stress further contributes to membrane damage.

Heat Stress disturbs the cellular homeostasis and can lead to severe retardation in growth and development, and even death.

High salinity, in particular sodium ions (Na+), can dissipate the membrane potential, is toxic to cell metabolism, has deleterious effects on the functioning of some of the plant's enzymes. In addition, high concentrations of Na+ cause osmotic imbalance, membrane disorganization, reduction in growth, inhibition of cell division/expansion, can lead to reduction in photosynthesis and production of reactive oxygen species.

Harsh drought conditions disrupt the normal bilayer structure of the membrane. In addition to membrane damage, cytosolic and organelle protein may exhibit reduced activity or may even undergo complete denaturation when dehydrated. Drought may also cause disruption of cellular metabolism and reduction in vegetative growth, in particular shoot growth.

Abscisic Acid (ABA) plays a primary regulatory role in the initiation and maintenance of seed and bud dormancy and in the plant's response to stress (e.g., freezing, salt stress and water stress (deficit of water). In addition, ABA influences many other aspects of plant development by interacting, usually as an antagonist with auxin, cytokinin, gibberellin, ethylene and brassinosteroids.

Studies of the promoters of several stress-induced genes have lead to the identification of specific regulatory sequences of genes involved in different stresses. A conserved sequence in many ABA-responsive genes has been reported to function as an ABA-responsive element (ABAR), which probably binds to transcription factors involved in ABA-regulated gene activation. A second sequence element found in the promoters of these genes is a dehydration response element (DRE) that is involved in the first rapid response to dehydration or salt. Over-expression of a DRE cDNA in transgenic plants was shown to activate the expression of many stress tolerance genes under normal growing conditions and to improve tolerance to drought, salt loading and freezing.

Deficiencies in macronutrients result in stunted growth, reduced biomass production and hastened senescence of older leaves. Suppression in plant growth and reduced biomass production may be attributed to decreased photosynthetic activity. Plants receiving deficient supplies of sulfur (S) and calcium (Ca) show greater suppression in the growth than nitrogen (N)-deficient plants, probably due to fairly immobile nature of S and Ca. Phosphor (P) deficiency in tobacco plants has been shown to decrease sink demands by limiting growth processes. The changes in the sink demands due to mineral nutrient deficiency may influence the partitioning of photosynthates and dry matter distribution leading to decreased shoot/root ratio.

Nutrient deficiency is predicted to be the single most important factor limiting crop yields during the 21st century, especially in developing countries. Soil acidity, alkalinity and salinity, anthropogenic activities, monoculture farming and wind and water erosion processes are the major degradation factors for cultivated soils. The poor productivity of crops grown in acid and salt affected soils is mainly due to combinations of elemental toxicities and deficiencies or unavailability of essential nutrients. Addition of fertilizers and amendments (particularly lime) are essential in achieving proper nutrient supply and maximizing yields in these soils. However, efficiency of applied fertilizers is very low and varies with crop species and genotype/cultivar within species, and their interactions with the environment. The world's total demand for food is likely to nearly double its present level by 2030, and there is limited new land available for expansion of cultivation to achieve this production level. Therefore, increasing crop yield potentials per unit of land is an urgent concern. The higher nutrient use efficiency in plants must be fully explored to increase food production to feed the growing human population, and this has to be achieved without accelerating environmental degradation from excessive fertilizer use.

Plant senescence, particularly in monocarpic (mostly annuals) species, is a correlatively controlled developmental process encountering at all stages in the life history of plants. However, certain stresses (such as drought and nutrient deficiency) and hormones are able to hasten or repress senescence. During leaf senescence, nutrients are recycled to other parts of the plant such as young leaves or storage tissues. Thus, senescence has a negative impact on yield due to the deterioration of leaf photosynthetic assimilation.

The main players among the plant hormones in the regulation of senescence processes are cytokinin, as the senescence retardant hormone, and ethylene, as the promoting hormone. Cytokinins control various processes in plant growth and development, such as proliferation (promote cell division) and differentiation (e.g., vascular development, leaf expansion, accumulation of chlorophyll and conversion of etioplasts into chloroplasts) of plant cells; they play a role in apical dominance, transduction of nutritional signals, control of shoot-root balance, crop productivity and senescence (delay leaf senescence). Cytokinins are present in all plant tissues and are abundant in root tips, shoot apex and immature seeds. Several studies have shown that a decrease in the flux of cytokinins from the roots up through the xylem is an important factor in the senescence of leaves. The expression level of cytokinin was shown to be highest in new developed tissues and to decrease in mature tissues, enabling senescence initiation.

The biosynthesis of cytokinins is catalyzed by adenosine phosphate-isopentenyltransferase (IPT), and it was found that over-expression of *Arabidopsis thaliana* IPT (AtIPT) genes results in phenotypes indicative of cytokinin overproduction as they show developmental and morphological alterations (Miyawaki K. et al. 2004, Plant J. 37: 128-38).

Leaf senescence program is accompanied and driven by changes in gene expression. Differential screening of cDNA libraries during senescence demonstrated that the expression of the vast majority of genes is down-regulated, whereas the expression of other genes [senescence-associated genes (SAGs)] is up-regulated (Buchanan-Wollaston V., 1994. *Plant Physiol.* 105: 839-846; Davies K M and Grieson D., 1989. *Planta,* 179: 73-80; Lohman K N, et al., 1994. *Physiologia Plantarum* 92: 322-328; Hajouj T, et al., 2000. *Plant Physiol.* 124: 1305-1314; Gepstein, S., et al., 2003. *The plant journal* 36: 629-642; Buchanan-Wollaston V, et al., 2003. *Plant Biotechnology Journal* 1: 3-22). Among the prominent SAGs are those predicted to be involved in the massive degradation of macromolecules and enzymes for nutrient recycling. Several of the genes which are up-regulated during leaf senescence are also upregulated under abiotic and biotic stresses (Binyamin L, et al., 2000. *Planta,* 211: 591-597; Buchanan-Wollaston V, 1997. *J. Exp. Bot.* 48: 181-199; Gepstein et al., 2003 (Supra); Guo Y, et al., 2004. *Plant, Cell and Environment* 27: 521-549; Hanfrey C, et al., 1996. *Plant Mol. Biol.* 30: 597-609; Quirino B F, et al., 1999. *Plant Mol. Biol.* 40: 267-278; Weaver L M, et al., 1997. Leaf senescence: gene expression and regulation. In: Setlow J K, ed. *Genetic engineering*, Vol 19. New York: Plenum Press, 215-234).

The Senescence-Associated Receptor Kinase (SARK) gene was identified in bean leaves (*Phaseolus vulgaris*) as an early SAG. The initiation of SARK expression occurs at late stages of leaf maturation, but appears immediately prior to some symptoms of senescence.

Gan S. and Amasino R M., 1995 (Inhibition of leaf senescence by autoregulated production of cytokinin. *Science* 270: 1986-1988) developed a senescence-inhibition system in which cytokinin production is specifically targeted to the senescence process by transforming plants with a chimeric construct containing the promoter of the highly regulated senescence specific gene-12 (SAG12) fused to the IPT coding sequence ($P_{SAG12}$-IPT). $P_{SAG12}$-IPT transgenic plants grew normally until the senescence stage, however, while leaf senescence progressed in the wild-type plants, the transgenic plants showed no visible sign of senescence at this stage.

PCT publication No. WO 2006/102559 discloses the generation of transgenic tobacco plant transformed with a construct containing the SARK promoter fused to the IPT gene. SARK-IPT transgenic plants display significant delay in senescence and enhanced tolerance to drought conditions and minimal reduction in biomass and seed yield of the plants when grown under limited water regime, demonstrating extreme resistance to drought conditions by enhanced photosynthetic rates and water use efficiency, provided by cytokinin expression (Rivero R M, et al., 2007. *PNAS* 104: 19631-19636). In addition, the cytokinin production in these plants resulted in protection of biochemical processes associated with photosynthesis and in induction of photorespiration, which may contribute to the protection of photosynthesis during water stress (Rivero R M, et al., 2009. Plant Physiol. 150: 1530-40).

Metallothionein (MT) genes encode a family of cysteine-rich, low molecular weight proteins present in a variety of organisms including bacteria, fungi and all eukaryotic plant and animal species which bind heavy metals through the thiol group of their cysteine (Cys) residues. Metallothioneins were found to be induced in several plants by a variety of abiotic stresses (e.g., drought, low temperature), including metal stress [e.g., Cadmium (Cd), ammonium, Cupper (Cu) or Zink (Zn)], following treatment with ABA (Clement., et al., 2008, Gene. 426:15-22) or Ethylene, nutrient deprivation, and during senescence (Gepstein et al., 2003, Supra). In addition, tobacco plants transformed with the MT gene exhibit enhanced tolerance to low temperature, drought and salt stress (Xue T., 2009, J. Exp. Bot. 60:339-49).

Additional background art includes Beinsberger S E I, et al., 1992 [Effects of enhanced cytokinin levels in ipt transgenic tobacco. In: Kamínek M, Mok D W S, Zazímalová. E, editors. *Physiology and Biochemistry of Cytokinins in Plants*. The Hague, The Netherlands: SPB Academic Publishing; pp. 77-82].

SUMMARY OF THE INVENTION

According to an aspect of some embodiments of the present invention there is provided a nucleic acid construct comprising a polynucleotide encoding adenosine phosphate-isopentenyltransferase (IPT) operably linked to a stress-related promoter.

According to an aspect of some embodiments of the present invention there is provided a nucleic acid construct comprising a polynucleotide encoding adenosine phosphate-isopentenyltransferase (IPT) operably linked to a Metallothionein (MT) promoter.

According to an aspect of some embodiments of the present invention there is provided a host cell transformed with the nucleic acid construct of some embodiments of the invention.

According to an aspect of some embodiments of the present invention there is provided a transgenic plant comprising the nucleic acid construct of some embodiments of the invention, or the host cell of some embodiments of the invention.

According to an aspect of some embodiments of the present invention there is provided a method of producing a transgenic plant, comprising expressing within the plant the nucleic acid construct of some embodiments of the invention.

According to an aspect of some embodiments of the present invention there is provided a method of increasing abiotic stress tolerance (ABST) of a plant, comprising expressing within the plant the nucleic acid construct of some embodiments of the invention, thereby increasing the abiotic stress tolerance of the plant.

According to some embodiments of the invention, the stress-related promoter comprises at least one copy of a cis regulatory element consisting of a nucleic acid sequence selected from the group consisting of SEQ ID NOs:2, 3, 4, 5, 6, 7, 8, 9, 10, 11, 12, 13, 14, 15, 16, 17, 18 and 19.

According to some embodiments of the invention, the stress-related promoter is an abiotic stress-related promoter.

According to some embodiments of the invention, the stress-related promoter is a promoter of an ABA-related gene.

According to some embodiments of the invention, the abiotic stress-related promoter is selected from the group consisting of SEQ ID NOs: 20-266, 267, 268, 269, 270, 237, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 70, 71, 327, 328, 329, 330, 331, 332, 333, 334, 335, 336, 337, 338, 339, 340, 341, 342, 188, 343, 344, 345, 346, 347, 348, 215, 349, 350, 351, 352, 353, 354, 120, 355, 356, 357, 358, 359, 360, 361, 362, 363, 364, 365, 366, 367, 368, 369, 370, 371, 372, 373, 374, 375, 376, 377, 378, 379, 218, 380, 381, 382, 383, 384, 385, 386, 387, 388, 389, 390, 391, 392, 393, 394, 395, 396, 397, 398, 399, 400, 401, 402, 403, 404, 314, 405, 77, 78, 301, 82, 83, 406, 407, 90, 408, 93, 95, 96, 97, 409, 322, 323, 410, 411, 412, 413, 100, 414, 415, 416, 417, 418, 118, 120, 419, 420, 126, 421, 135, 422, 423, 424, 425, 426, 427, 144, 147, 148, 428, 429, 171, 185, 188, 430, 431, 369, 432, 433, 434, 435, 436, 202, 203, 205, 437, 438, 207, 439, 440, 215, 441, 442, 218, 380, 221, 443, 444, 287, 227, 228, 445, 237, 446, 249, 447, 448, 449, 450, 451, 452, 453, 258, 261, 55, 454, 56, 58, 59, 60, 61, 62, 63, 65, 68, 69, 405, 70, 73, 74, 75, 77, 455, 78, 456, 457, 458, 459, 79, 80, 81, 82, 83, 84, 85, 86, 87, 89, 90, 91, 92, 93, 95, 96, 97, 98, 99, 322, 410, 460, 461, 462, 463, 413, 102, 103, 104, 110, 112, 117, 118, 120, 121, 122, 125, 131, 133, 134, 135, 140, 142, 143, 144, 147, 464, 148, 149, 465, 150, 466, 151, 467, 155, 156, 160, 161, 163, 166, 168, 428, 170, 172, 175, 178, 179, 181, 184, 186, 189, 191, 200, 201, 202, 203, 468, 469, 205, 437, 206, 470, 208, 30, 209, 211, 471, 212, 213, 214, 215, 441, 218, 380, 219, 472, 220, 473, 474, 475, 476, 443, 223, 477, 224, 478, 225, 227, 228, 229, 479, 230, 231, 232, 233, 480, 234, 237, 238, 239, 240, 244, 245, 246, 481, 248, 249, 448, 482, 483, 449, 450, 250, 253, 254, 255, 451, 452, 484, 485, 257, 258, 259, 260, 486, 261, 263, 264, 487, 265, 266, 584, 585, 586, 587, 588, 589, 395, 590, 233, 591, 592, 593, 594, 595, 596, 597, 598, 599, 314, 600, 601, 602, 603, 604, 605, 606, 607, 442, 608, 609, 610, 611, 612, 613, 614, 615, 616, 617, 618, 619, 393, 620, 386, 621, 622, 376, 623, 624, 625, 626, 627, 628, 403, 629, 630, 631, 632, 633, 410, 634, 635, 385, 368, 636, 387, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 221, 667, and 668.

According to some embodiments of the invention, the promoter of the ABA-related gene is selected from the group consisting of SEQ ID NOs: 55, 488, 489, 56, 490, 57, 59, 60, 61, 491, 64, 65, 492, 68, 493, 69, 405, 70, 71, 72, 73, 74, 75, 78, 494, 457, 495, 458, 496, 459, 301, 80, 497, 82, 83, 85, 86, 407, 89, 90, 91, 92, 93, 95, 96, 97, 409, 99, 498, 460, 461, 462, 413, 102, 104, 105, 106, 499, 500, 108, 501, 111, 502, 113, 503, 114, 504, 505, 418, 506, 118, 119, 120, 121, 507, 122, 123, 508, 509, 510, 511, 125, 126, 127, 512, 421, 513, 514, 515, 516, 131, 134, 517, 518, 519, 520, 521, 522, 523, 136, 139, 145, 146, 524, 147, 464, 525, 149, 150, 151, 152, 526, 159, 160, 161, 527, 162, 163, 528, 165, 168, 428, 529, 429, 530, 171, 172, 176, 178, 179, 531, 181, 532, 533, 188, 534, 189, 190, 194, 196, 535, 536, 537, 367, 538, 203, 204, 468, 469, 539, 205, 540, 541, 437, 438, 206, 207, 542, 439, 543, 544, 30, 209, 545, 211, 471, 212, 546, 547, 548, 549, 550, 442, 218, 380, 551, 472, 552, 553, 554, 555, 473, 556, 557, 221, 474, 476, 222, 443, 477, 224, 558, 559, 478, 225, 226, 227, 228, 229, 479, 230, 231, 232, 560, 233, 561, 480, 562, 234, 235, 236, 563, 564, 238, 239, 241, 242, 243, 565, 566, 244, 245, 481, 567, 247, 568, 569, 248, 249, 482, 570, 483, 449, 571, 250, 251, 572, 573, 574, 253, 254, 575, 576, 577, 578, 256, 451, 579, 452, 484, 485, 580, 257, 259, 581, 260, 582, 583, 262, 264, and 265.

According to some embodiments of the invention, the stress-related promoter is a Metallothionein (MT) promoter.

According to some embodiments of the invention, the Metallothionein (MT) promoter comprises the nucleic acid sequence selected from the group consisting of SEQ ID NOs:686-693.

According to some embodiments of the invention, the Metallothionein (MT) promoter is set forth by SEQ ID NO:693.

According to some embodiments of the invention, the IPT comprises an amino acid sequence selected from the group consisting of SEQ ID NOs:673-378.

According to some embodiments of the invention, the polynucleotide encoding the IPT comprises a nucleic acid sequence selected from the group consisting of SEQ ID NOs:679-685.

According to some embodiments of the invention, the cell is a plant cell.

According to some embodiments of the invention, the plant cell forms part of a plant.

According to some embodiments of the invention, the abiotic stress is selected from the group consisting of drought, cold stress, chilling stress, heat stress, salinity stress, osmotic stress, freeze stress, nutrient deficiency and heavy metal stress.

According to some embodiments of the invention, the method further comprising growing the plant under the abiotic stress.

According to some embodiments of the invention, the host cell of some embodiments of the invention, the plant of some embodiments of the invention, or the method of some embodiments of the invention, wherein the IPT is set forth by SEQ ID NO:694.

According to some embodiments of the invention, the nucleic acid construct comprises the nucleic acid sequence set forth by SEQ ID NO:1.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings:

Figure 1:
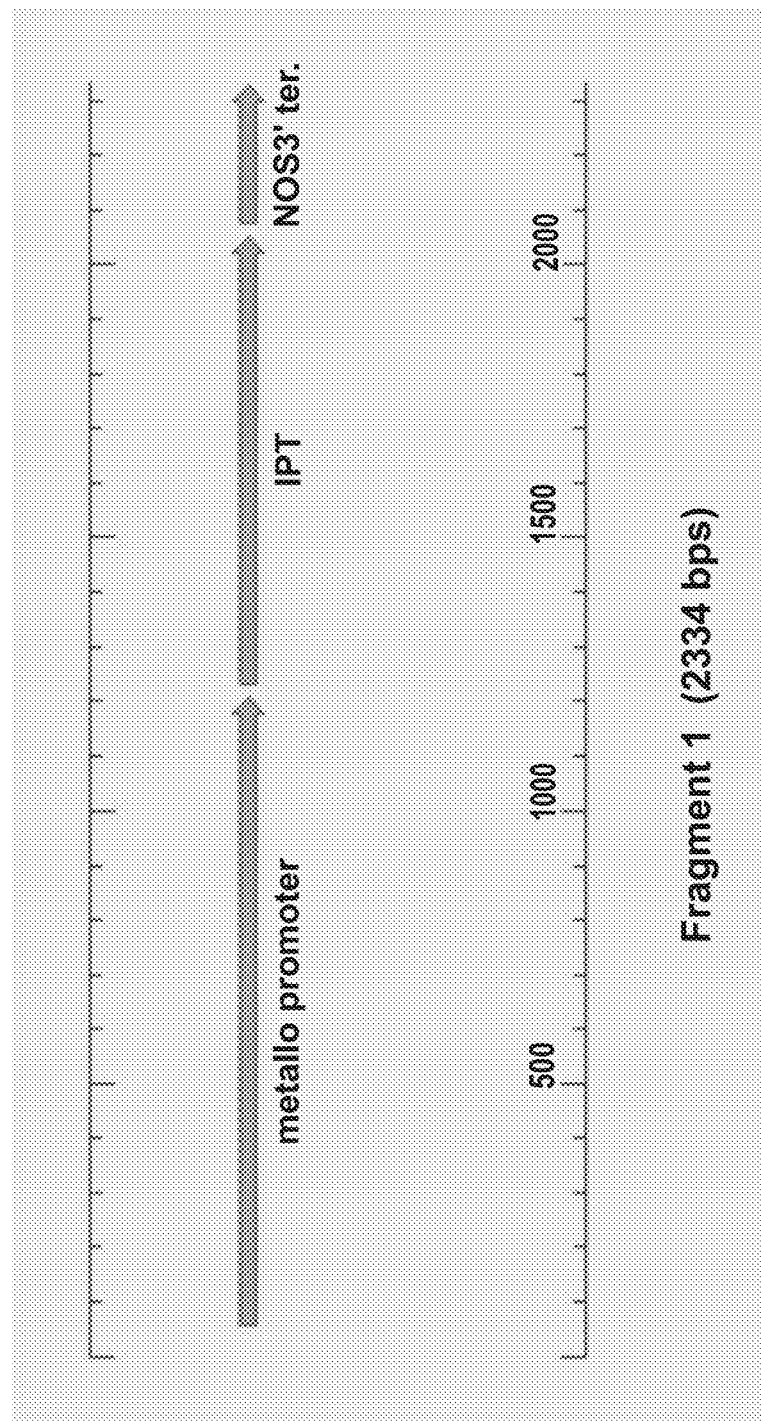

FIG. 1 is a schematic illustration depicting the structure of the nucleic acid construct according to some embodiments of the invention. The plasmid pJHA212K which includes the 35S promoter [Yoo, S. Y., Bomblies, K., Yoo, S. K., Yang, J. W., Choi, M. S., Lee, J. S., Weigel, D., Ahn, J. H. (2005). "The 35S promoter used in a selectable marker gene of a plant transformation vector affects the expression of the transgene." Planta 221: 523-530] was used as a template in order to generate the expression vector of some embodiments of the invention in which the 35S promoter was replaced by the metallothionein promoter.

FIG. 2 depicts the nucleic acid sequence of the metallothionein promoter-IPT-NOS terminator construct (pM-IPT) according to some embodiments of the invention (SEQ ID NO:1). The metallothionein promoter (shown in blue letters) is set forth by nucleotides 57-1208 of SEQ ID NO:1; the IPT coding sequence (shown in black letters) is set forth by nucleotides 1233-2051 of SEQ ID NO:1; and the NOS terminator (shown in red letters) is set forth by nucleotides 2075-2328 of SEQ ID NO:1.

Figure 3:
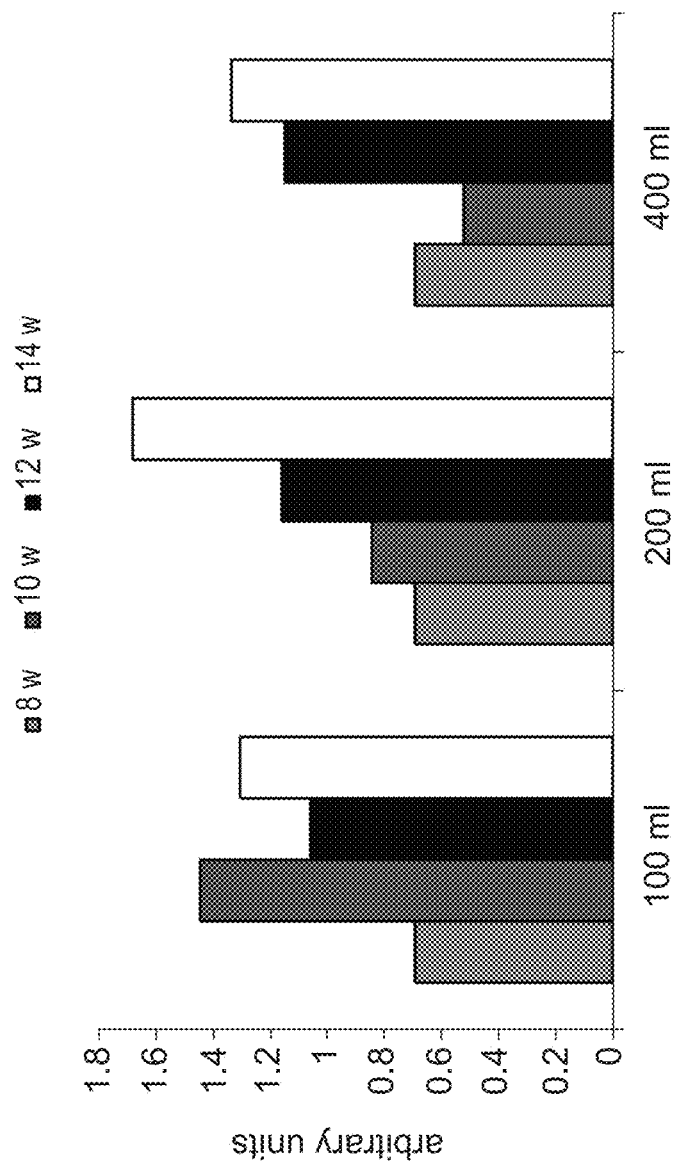

FIG. 3 is a histogram depicting IPT expression (in arbitrary units) in transgenic plants expressing the metallothionein-promoter-IPT coding sequence construct (M-IPT8 plants) grown under restricted water regimens. Plants were grown in simulated drought conditions, for 8-14 weeks, watered with 100, 200 and 400 ml of water every two days. 8 weeks (green bars); 10 weeks (red bars); 12 weeks (black bars); and 14 weeks (white bars). IPT expression was examined and quantified relative to the 18s expression. The results are an average of two independent revisions.

Figure 4A:
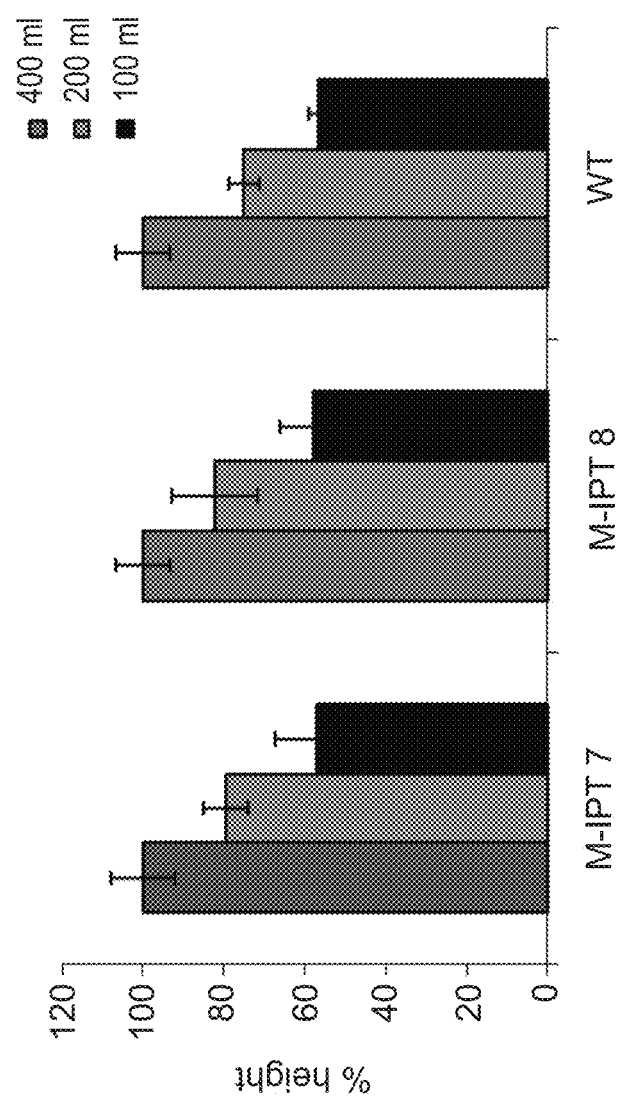
Figure 4C:
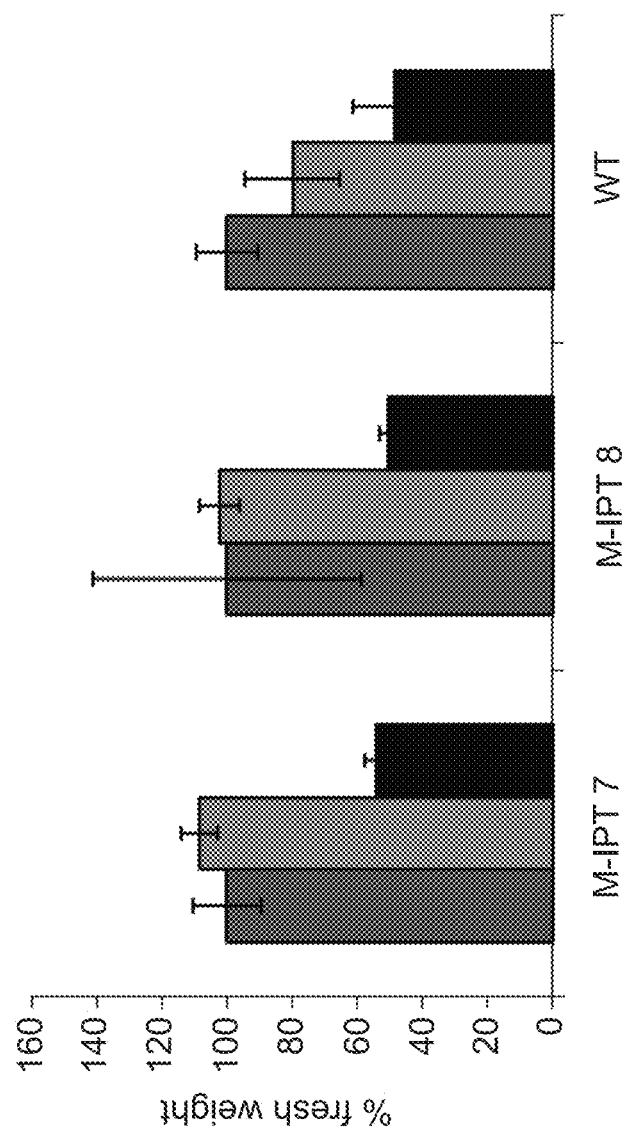

FIGS. 4A-C are histograms depicting the effect of the transgene (pM-IPT) on plant height (FIG. 4A), number of leaves (FIG. 4B) and fresh weight (FIG. 4C) under water limiting conditions. Plants (M-IPT7, M-IPT8, and wild type) were grown in various drought conditions, watered with 400 ml (red bars), 200 ml (green bars) and 100 ml (black bars) tap water every two days. Biomass (fresh weight), height and number of leaves of plants grown under these conditions for 2 months were examined. Values are presented as percentage compared to the value in the 400 ml watering treatment as measured in each line (control or transgenic).

FIGS. 5A-C are photographs depicting the growth of wild-type (WT) and pM-IPT transgenic plants in optimal and limited water regimes. Four month old plants grown under various drought conditions, watered with 400, 200 and 100 ml of water every two days. Four hundred ml water is the optimal amount of water for plant growth in this experiment. Decease in chlorophyll content is an indication for senescence and can be seen in the WT plants much more than in the transgenic plants. In addition, the transgenic plants exhibit increased growth as shown by plant's height and size of leaves (a measure of biomass), which is higher than in WT plants of the same age (4-months old plants).

FIGS. 6A-C are photographs depicting the effect of limited water regimes, on root growth in WT and pM-IPT transgenic plants. At the end of the experiments roots were cleaned from soil of four month old plants grown in simulated drought conditions, watered with 400, 200 and 100 ml of water every two days. Four hundred ml water is the optimal amount of water for plant growth.

Figure 7:
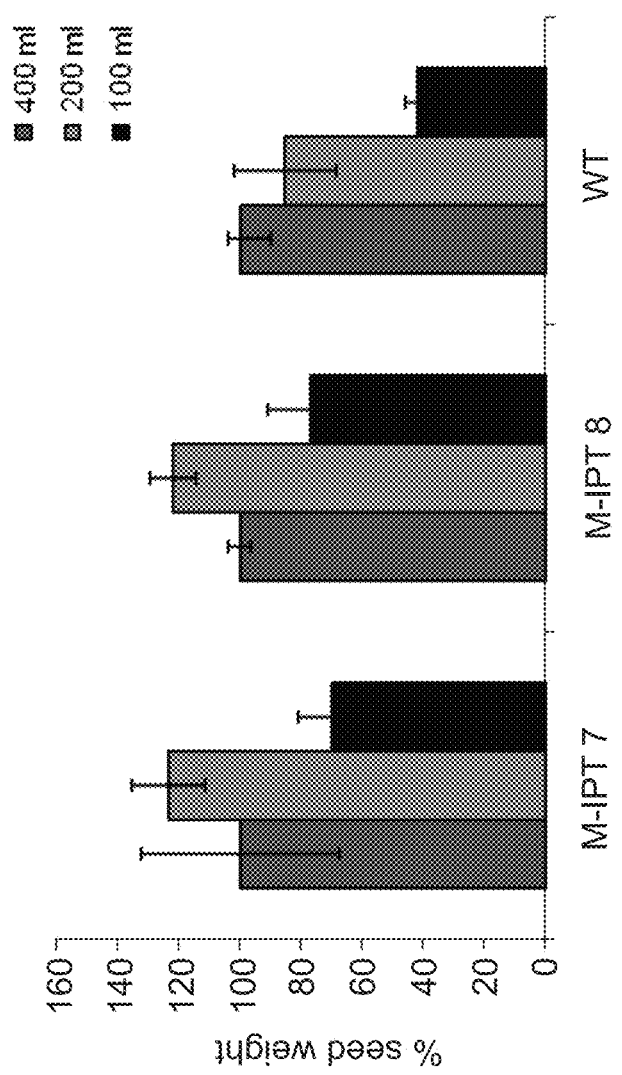

FIG. 7 is a histogram depicting seed weight of plants grown in limited water regimes expressed as percentages compared to the optimal water regime. Plants were grown in simulated drought conditions, watered with 400 ml (red bars), 200 ml (green bars) and 100 ml (black bars) of water every two days. The fruits were left to dry, and weight of mature seeds was checked. Values are presented as percentage compared to the value in the 400 ml watering treatment.

FIGS. 8A-D are photographs depicting the growth of WT and pM-IPT transgenic plants under drought conditions. Watering of mature tobacco plants was stopped for two weeks and was then re-watered. FIG. 8A—WT and pM-IPT plants before drought; FIG. 8B—WT and pM-IPT plants after two weeks of drought; FIG. 8C—WT and pM-IPT plants one day after re-watering. FIG. 8D—WT and M-IPT plants three days after re-watering.

Figure 9:
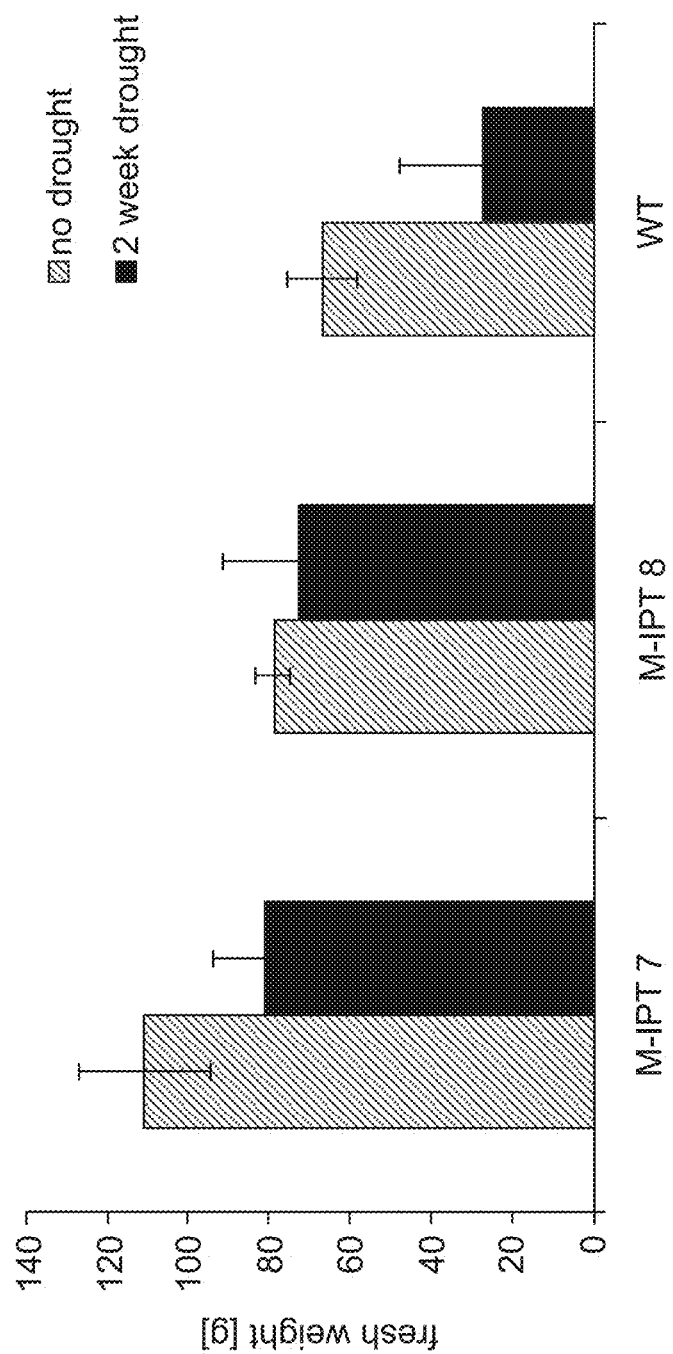

FIG. 9 is a histogram depicting biomass of WT and pM-IPT plants (M-IPT7 and M-IPT8) grown in drought conditions. The watering of mature tobacco plants was stopped for two weeks and was then resumed. Biomass of the plants (fresh weight) grown with no water for two weeks was compared to plants grown under optimal water supply.

Figures 10A, 10B, 10C, 10D:
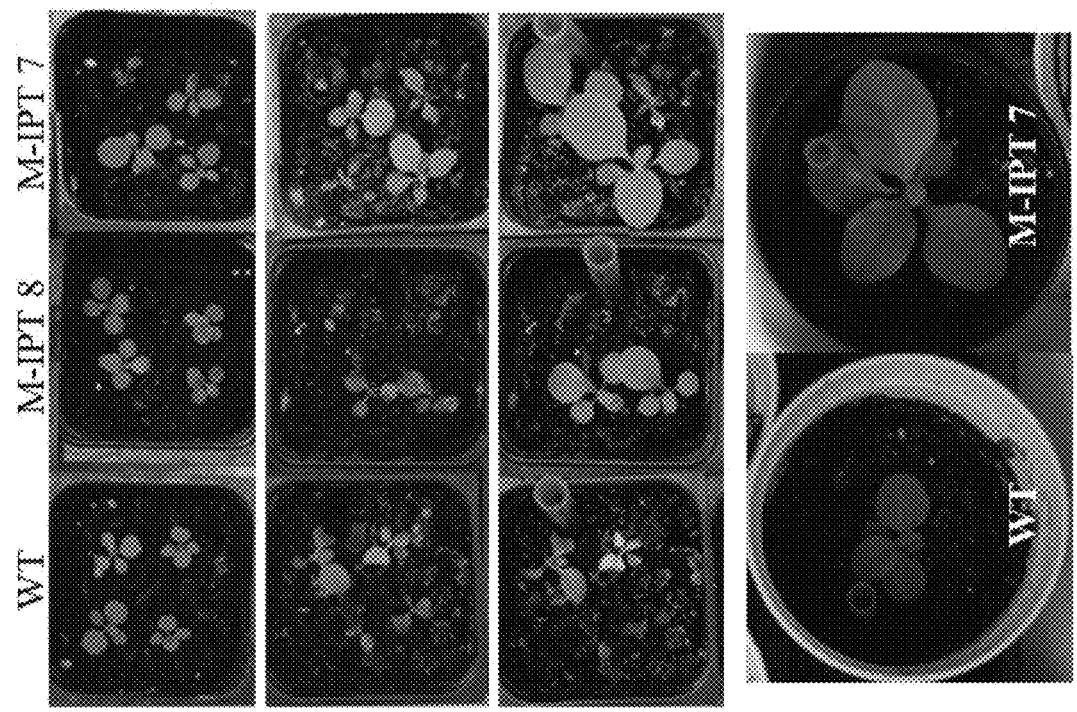

FIGS. 10A-D are photographs depicting the growth and recovery of M-IPT tobacco plants after heat stress. WT and M-IPT (M-IPT8 and M-IPT7) plants were grown for 1 week under heat stress and then transferred back to room temperature for recovery. FIG. 10A—Three week old tobacco plants before stress; FIG. 10B—tobacco plants after 1 week of heat stress at 37° C.; FIG. 10C— tobacco plants after 1 week of recovery; FIG. 10D—tobacco plants after 2 weeks of recovery from heat stress.

FIGS. 11A-D are photographs depicting the growth and recovery of M-IPT tobacco plants after low temperature stress. WT and M-IPT (M-IPT8 and M-IPT7) plants were grown for 1 week under cold stress and then transferred back to room temperature for recovery. FIG. 11A—Three week old tobacco plants before stress; FIG. 11B—tobacco plants after 1 week of cold stress at 4° C.; FIG. 11C—tobacco plants after 2 week of recovery. Description of rows from left to right: first two rows from left—WT; 2 middle rows—M-IPT8; last two rows—M-IPT7; FIG. 11D—tobacco plants after 4 week of recovery from cold stress. Note that the M-IPT plants are unexpectedly much larger than the WT plants.

Figure 12A:
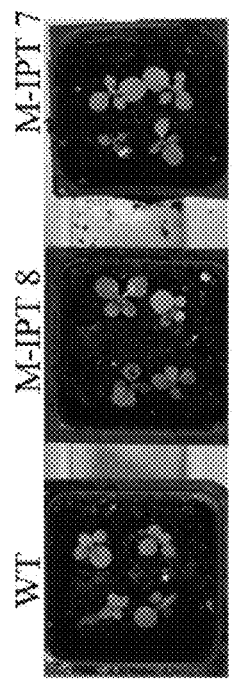
Figure 12B:
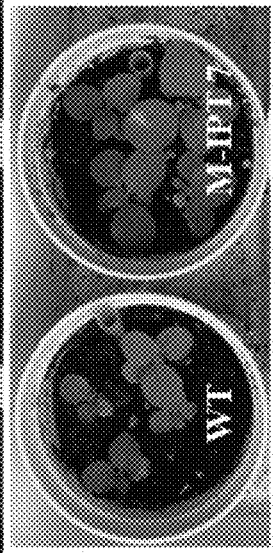
Figure 12C:
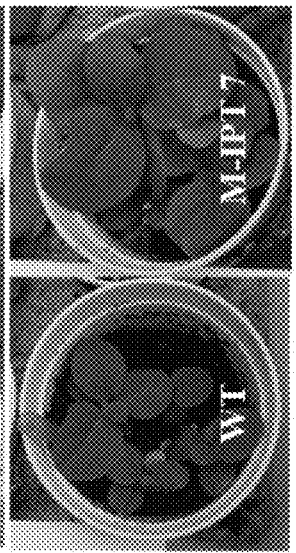
Figure 12D:
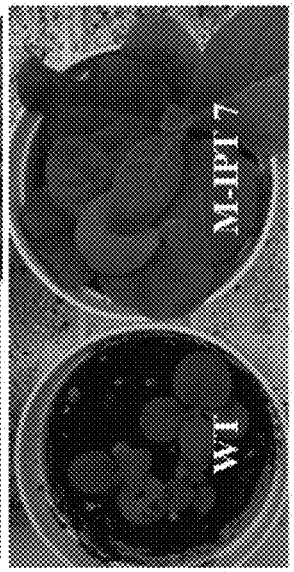

FIGS. 12A-D are photographs depicting the growth and recovery of M-IPT tobacco plants after salt stress. WT and M-IPT (M-IPT8 and M-IPT7) were grown for 3 weeks under salt stress, watered with 300 mM NaCl and then transferred back to normal watering for recovery. FIG. 12A—Three week old tobacco plants, before stress; FIG. 12B—tobacco plants after 3 weeks of high salinity; FIG. 12C—tobacco plants after 1 week of recovery; FIG. 12D—tobacco plants after 2 weeks of recovery from salt stress.

Figures 13A, 13B, 13C:
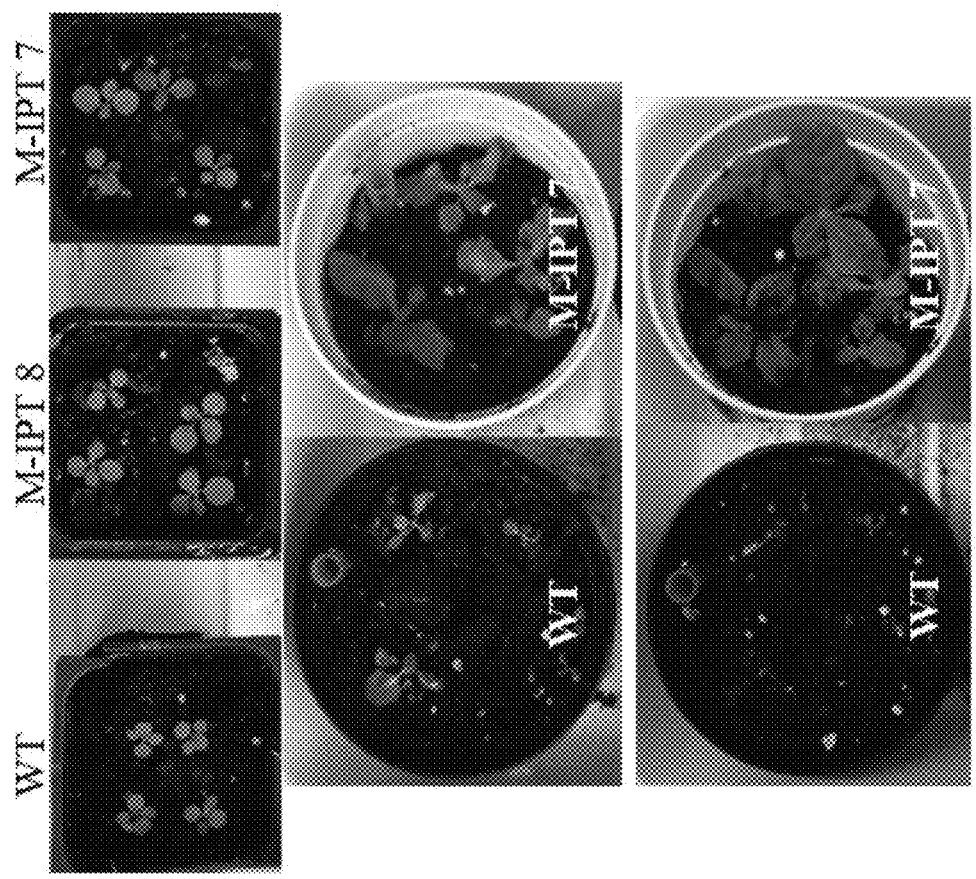

FIGS. 13A-C are photographs depicting the growth and recovery of M-IPT tobacco plants (M-IPT8 and M-IPT7) after osmotic stress. WT and M-IPT plant were grown for 3 weeks under salt stress, watered with 20% PEG 6000, and then transferred back to normal watering for recovery. FIG. 13A—Three weeks old tobacco plants, before stress; FIG. 13B—tobacco plants after 3 weeks of osmotic stress; FIG. 13C—tobacco plants after 2 week of recovery.

FIGS. 14A-C are photographs depicting the recovery of M-IPT tobacco plants (M-IPT8 and M-IPT7) after severe abiotic stresses. WT and M-IPT plants were grown for 1 week under cold stress, for 1 week under heat stress, for 3 weeks under salinity stress (watered with 300 mM of NaCl) and then transferred to room temperature and normal watering for recovery. FIG. 14A—WT and M-IPT plants after a 4 weeks recovery period from the cold stress; FIG. 14B—WT and M-IPT plants following 4 weeks of recovery from the heat stress; FIG. 14C—WT and M-IPT plants following 2 weeks of recovery from the salinity stress.

Figure 15:
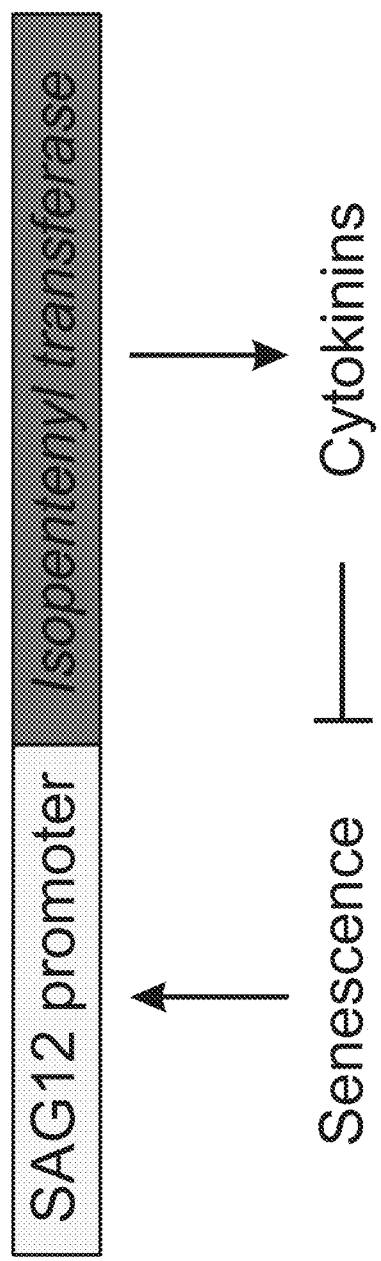

FIG. 15 is a schematic illustration depicting the SAG12 promoter-IPT construct.

Figure 16:
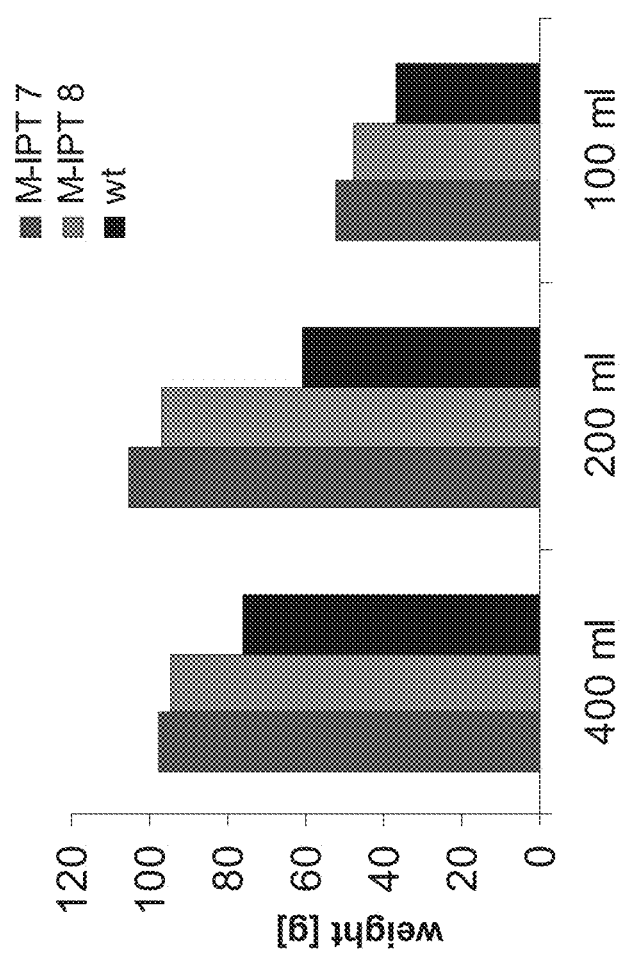

FIG. 16 is a histogram depicting the biomass (in grams) of WT and M-IPT plants grown in optimal (400 ml) and limited (200 or 100 ml) water regimes. Plants (tobacco) were grown in various drought conditions, watered with 400, 200 and 100 ml water every two days. Biomass (fresh weight) of the total leaves per plant grown in these conditions was examined after 2 months. Results represent an average of 3 plants in each treatment.

Figures 17A, 17B, 17C, 17D:

FIGS. 17A-D are photographs depicting the growth of M-IPT tobacco plants under salt stress. Wild type (WT) and M-IPT1 transgenic plants were grown for 3 weeks in Petri dishes containing ½ MSO media with or without 150 mM NaCl, for salt stress or normal conditions, respectively. Growth conditions included day length 16\8 (day\night) at 25° C. FIG. 17A—WT without salt stress; FIG. 17B—WT with salt stress; FIG. 17C—M-IPT1 without salt stress; FIG. 17D—M-IPT1 with salt stress. Note that the M-IPT construct confers increased tolerance of plants to salt stress.

Figures 18A, 18B, 18C, 18D:
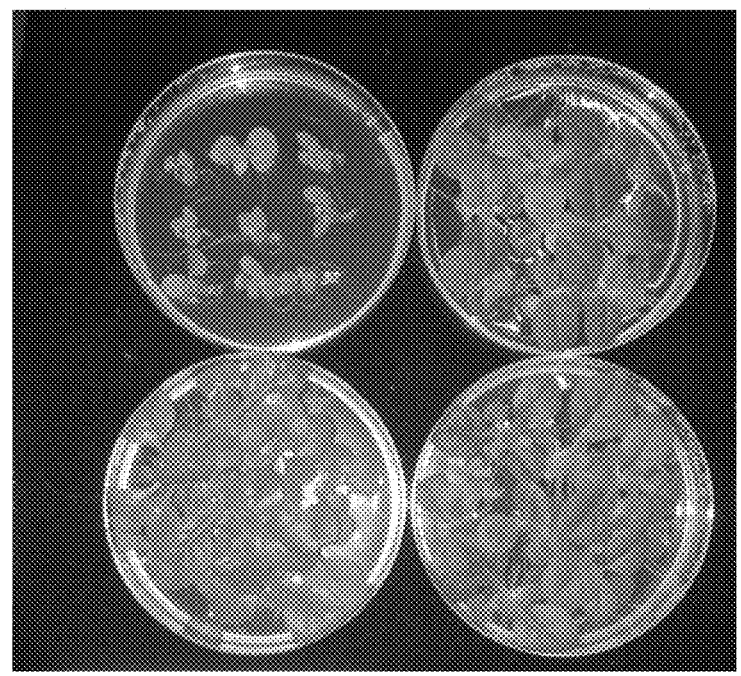

FIGS. 18A-D are photographs depicting the growth of M-IPT tobacco plants under salt stress. Wild type (WT) and M-IPT2 transgenic plants were grown for 3 weeks in Petri dishes containing ½ MSO media with or without 150 mM NaCl, for salt stress or normal conditions, respectively. Growth conditions included day length 16\8 (day\night) at 25° C. FIG. 18A—WT without salt stress; FIG. 18B—WT with salt stress; FIG. 18C—M-IPT2 without salt stress; FIG. 18D—M-IPT2 with salt stress. Note that the M-IPT construct confers increased tolerance of plants to salt stress.

Figures 19A, 19B, 19C, 19D:
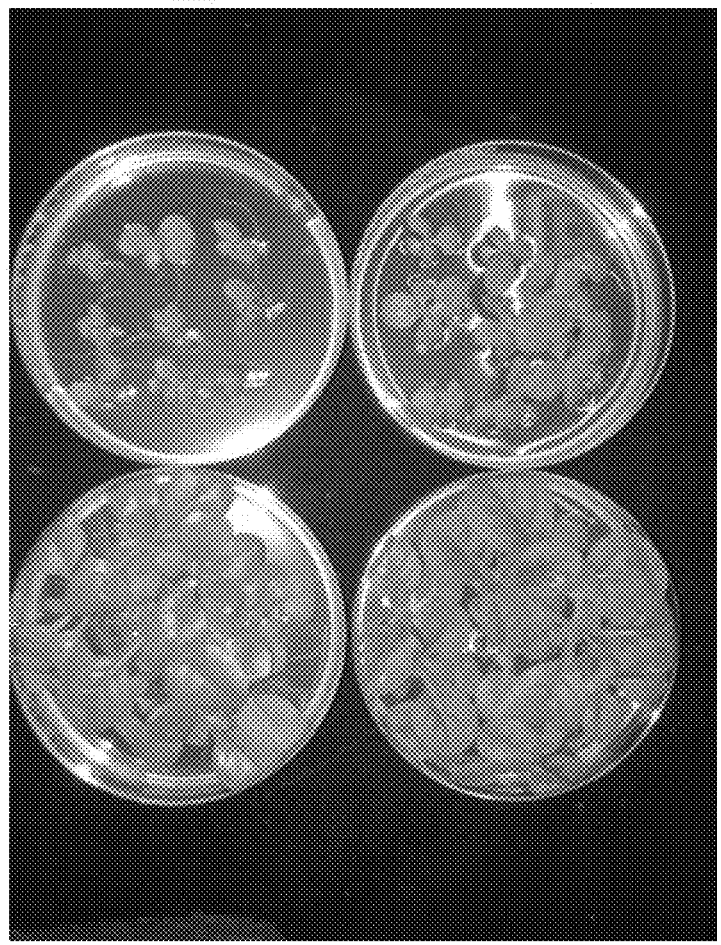

FIGS. 19A-D are photographs depicting the growth of M-IPT tobacco plants under salt stress. Wild type (WT) and M-IPT5 transgenic plants were grown for 3 weeks in Petri dishes containing ½ MSO media with or without 150 mM NaCl, for salt stress or normal conditions, respectively. Growth conditions included day length 16\8 (day\night) at 25° C. FIG. 19A—WT without salt stress; FIG. 19B—WT with salt stress; FIG. 19C—M-IPT5 without salt stress; FIG. 19D—M-IPT5 with salt stress. Note that the M-IPT construct confers increased tolerance of plants to salt stress.

FIGS. 20A-D are photographs depicting the growth of SARK-IPT tobacco plants under salt stress. Wild type (WT) and SARK-IPT transgenic plants were grown for 3 weeks in Petri dishes containing ½ MSO media with or without 150 mM NaCl, for salt stress or normal conditions, respectively. Growth conditions included day length 16\8 (day\night) at 25° C. FIG. 20A—WT without salt stress; FIG. 20B—WT with salt stress; FIG. 20C—SARK-IPT without salt stress; FIG. 20D—SARK-IPT with salt stress. Note that the SARK-IPT construct fails to confer resistance or increased tolerance of the plants to salt stress.

DESCRIPTION OF SPECIFIC EMBODIMENTS OF THE INVENTION

The present invention, in some embodiments thereof, relates to nucleic acid constructs encoding IPT under a stress-related promoter and more particularly, but not exclusively, to methods of using same for generating transgenic plants with increased abiotic stress tolerance and increased yield, biomass and growth rate under normal or stress conditions.

Before explaining at least one embodiment of the invention in detail, it is to be understood that the invention is not necessarily limited in its application to the details set forth in the following description or exemplified by the Examples. The invention is capable of other embodiments or of being practiced or carried out in various ways.

The present inventors have uncovered that a nucleic acid construct which comprises the adenosine phosphate-isopentenyltransferase (IPT) coding sequence under the transcriptional regulation of a stress-related promoter can be used to increase tolerance and resistance of transgenic plants expressing same to various abiotic stresses.

Thus, as shown in the Examples section which follows, auto regulated expression of the IPT coding sequence under the regulation of a stress related promoter was higher under limited water regimes than under optimal conditions (FIG. 3, Example 1). In addition, transgenic plants transformed with the stress promoter-IPT nucleic acid construct of some embodiments of the invention exhibit increased tolerance to drought stress as shown by the significant less reduction in the number of leaves per plant (FIG. 4B, Example 1); maintain a stable biomass under 50% water regimes (FIG. 4C, Example 1); a high chlorophyll level and increased biomass for an extended period under drought conditions (FIGS. 5A-C, Example 1); increased size of root system and weight under drought conditions (FIGS. 6A-C, Example 1); maintain stable yield (FIG. 7, Example 1) under drought stress; recover well from long-term drought stress (FIGS. 8A-D and FIG. 9, Example 1); recover well and fast from heat stress (FIGS. 10A-D, Example 2), cold stress (FIGS. 11A-D, Example 2); salinity stress (FIGS. 12A-D, Example 2); osmotic stress (FIGS. 13A-C, Example 2) and severe abiotic stress (FIGS. 14A-C, Example 2) as compared to non-transformed wild type plants under the same growth conditions; and exhibit increased tolerance to salinity stress as evidenced by plant survival and size of leaves as compared to wild type plants under identical conditions (FIGS. 17-19; Example 6). Altogether, these results suggest the use of a nucleic acid construct which includes the IPT coding sequence under the transcriptional regulation of a stress promoter for increasing tolerance of plants to various abiotic stresses and for increasing biomass and chlorophyll content under normal conditions, even following extended growth period, in which wild type plant usually begin to senesce.

Thus, according to an aspect of some embodiments of the invention there is provided a nucleic acid construct comprising a polynucleotide encoding adenosine phosphate-isopentenyltransferase (IPT) operably linked to a stress-related promoter.

As used herein the phrase "adenosine phosphate-isopentenyltransferase (IPT)", "isopentenyl transferase" (also known as "tmr") refers to a polypeptide which participates in the biosynthesis of cytokinins. IPT was cloned from various species including plants and bacteria, such as *Agrobacterium tumefaciens* [gi 190014648, GenBank Accession No. YP_001967412.1 (SEQ ID NO: 673), GeneID: 6382121]; NP_396529 (SEQ ID NO: 674, GeneID: 1137335); gi 10955021, GenBank Accession No. NP_059677.1 (SEQ ID NO: 675), GeneID: 1224196], *Glycine max* [GeneID: 547754, GenBank Accession No. AAT28191.1 (SEQ ID NO: 676), GeneID: 547754]; *Zea mays* [GeneID: 100174970; GenBank Accession No. NP_001127753; (SEQ ID NO: 677)], and *Agrobacterium vitis* [GeneID: 7365249, GenBank Accession No. YP_002540151 (SEQ ID NO: 678)]. Accordingly, various polynucleotide coding sequences are available via various sources such as the National Center for Biotechnology Information (NCBI) at Hypertext Transfer Protocol://World Wide Web (dot) ncbi (dot) nlm (dot) nih (dot) gov.

Non-limiting examples of IPT coding sequences include, AY550884.1 (SEQ ID NO:679), NM_001134281.1 (SEQ ID NO:680), nucleotides 221625-222335 of GenBank Accession No. NC_011982.1 (SEQ ID NO:681 only of the selected region by nucleotide positions), nucleotides 11107-12012 of GenBank Accession No. NC_010929.1 (SEQ ID NO:682 only of the selected region by nucleotide positions), nucleotides 19337-20059 of GenBank Accession No. NC_003065.3 (SEQ ID NO:683 only of the selected region by nucleotide positions), nucleotides 7664-8586 of GenBank Accession NO. NC_002377.1 (SEQ ID NO:684 only of the selected region by nucleotide positions), and nucleotides 52740-53462 of GenBank Accession No. NC_003065.2 (AGR_pTi_50, also known as Tmr, isopentenyl transferase, GeneID 1142635; SEQ ID NO:685).

It should be noted that homologous genes encoding a polypeptide at least 80% identical (e.g., by global homology) to the IPT polypeptide selected from the group consisting of SEQ ID NOs:673-678 are also contemplated by some embodiments of the invention.

According to some embodiments of the invention, the IPT coding sequence is set forth by SEQ ID NO:694; which includes nucleotides 1233-2051 of SEQ ID NO:1).

As used herein, "operably linked" refers to positioning of a regulatory region (a stress related promoter in this case) relative to a nucleic acid sequence (e.g., a polynucleotide encoding IPT) in such a way so as to permit or facilitate transcription of the nucleic acid sequence in a host cell.

As used herein, the term "promoter" refers to a region of DNA to which RNA polymerase binds to initiate transcription of the RNA encoded by the gene. The promoter controls the level of expression of the gene, where the gene is expressed (e.g., which portion/tissue of a plant) and/or when the gene is expressed (e.g., at which stage or condition in the lifetime of an organism).

According to some embodiments of the invention, the promoter lies upstream of the transcriptional initiation site of a gene.

According to some embodiments of the invention, the first nucleotide (i.e., the 5'-end) of the promoter sequence is positioned 1-500 base pair (bp) upstream of the translation start site (in most genes, the ATG codon) of the coding nucleic acid sequence operably linked thereto, although it will be appreciated that regulatory sequences can also exert their effect when positioned elsewhere with respect to the coding nucleic acid sequence (e.g., within an intron).

According to some embodiments of the invention, the first nucleotide (i.e., the 5'-end) of the promoter sequence is positioned about 1-600 bp, about 1-700 bp, about 1-800 bp, about 1-900 bp, about 1-1000 bp, about 1-1100 bp, about 1-1200 bp, about 1-1300 bp, about 1-1400 bp, about 1-1500 bp, about 1-1600 bp, about 1-1700 bp, about 1-1800 bp, about 1-1900 bp, about 1-2000 bp, about 1-2500 bp, about 1-3000 bp or more upstream of the translation start site of the coding nucleic acid sequence operably linked thereto.

As used herein the phrase "stress-related promoter" refers to any promoter which transcriptional promoting activity thereof is upregulated under a stress condition as compared to under normal (e.g., non-stress, optimal) conditions. Accordingly, the expression level of a coding sequence operably linked to the stress-related promoter is higher under the stress condition than under the non-stress conditions.

The phrase "stress" used herein refers to any adverse effect in metabolism, growth, biomass, reproduction yield and/or viability of a plant. Accordingly, abiotic stress can be induced by suboptimal environmental growth conditions such as, for example, salinity, water deprivation, flooding, freezing, low or high temperature, heavy metal toxicity, anaerobiosis, nutrient deficiency (including also nutrient inaccessibility such as due to leaching), atmospheric pollution or UV irradiation. Biotic stress is caused for example by pathogens which are found in the environment such as bacteria, viruses, fungi, parasites, as well as insects and weeds.

According to some embodiments of the invention the abiotic or biotic stress causes a reduction in metabolism, growth, biomass, reproduction yield and/or viability of a plant.

Various promoters are known to be upregulated under stress, i.e., capable of increasing the expression level of a coding sequence operably linked thereto under a stress condition. Such promoters can be identified by monitoring the expression pattern of the endogenous gene being under the transcriptional regulation of the promoter. Thus, if the gene expression is upregulated under a stress condition relative to an expression of the same gene under non-stress conditions (e.g., optimal conditions) then the promoter sequence is considered a stress-related promoter. Some of these promoters share common regulatory sequences (e.g., cis regulatory sequences which are present upstream on the same chromosome as the coding sequence) which serve as binding sites for transcription factors assisting in the transcription of the regulated coding sequence.

Following is a non-limiting list of stress-related cis regulatory elements which are comprised in the stress-related promoter of the nucleic acid construct of some embodiments of the invention: ABRE (ABA response element)-PyACGTG(T/G)C (SEQ ID NO:2) such as TACGTGTC (SEQ ID NO:3), CACGTGGC (SEQ ID NO:4), PyACGTGGC (SEQ ID NO:7), ACGTGTC (SEQ ID NO:10), ACGTGTC (SEQ ID NO:11), ACGTGGC (SEQ ID NO:14); DRE (dehydration response element)-TACCGACAT (SEQ ID NO:5); CCGAC Core Motif—CCGAC (SEQ ID NO:6); CE1—TGCCACCGG (SEQ ID NO:8); CE3—ACGCGTGCCTC (SEQ ID NO:9); MYBR—TGGTTAG (SEQ ID NO:12); MYCR—CACATG (SEQ ID NO:13); CRT—GGCCGACAT (SEQ ID NO:15); LTRE—GGCCGACGT (SEQ ID NO:16); NACR—ACACGCATGT (SEQ ID NO:17); ZFHDR; ICEr1—GGACACATGTCAGA (SEQ ID NO:18); ICEr2—ACTCCG (SEQ ID NO:19).

According to some embodiments of the invention, the abiotic stress promoter is a promoter which is active under a salt stress (salinity). Non-limiting examples of salt stress related promoters which can be used according to some embodiments of the invention include the promoter sequences set forth by SEQ ID NOs:20-266 (Table 2, Example 5 of the Examples section which follows).

According to some embodiments of the invention, the abiotic stress promoter is a promoter which is active (e.g., induces or dictates gene expression) under a cold stress. Non-limiting examples of cold stress related promoters which can be used according to some embodiments of the invention include the promoter sequences set forth by SEQ ID NOs:267, 268, 269, 270, 237, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 70, 71, 327, 328, 329, 330, 331, 332, 333, 334, 335, 336, 337, 338, 339, 340, 341, 342, 188, 343, 344, 345, 346, 347, 348, 215, 349, 350, 351, 352, 353, 354, 120, 355, 356, 357, 358, 359, 360, 361, 362, 363, 364, 365, 366, 367, 368, 369, 370, 371, 372, 373, 374, 375, 376, 377, 378, 379, 218, 380, 381, 382, 383, 384, 385, 386, 387, 388, 389, 390, 391, 392, 393, 394, 395, 396, 397, 398, 399, 400, 401, 402, 403, 404, 314, 405, 77, 78, 301, 82, 83, 406, 407, 90, 408, 93, 95, 96, 97, 409, 322, 323, 410, 411, 412, 413, 100, 414, 415, 416, 417, 418, 118, 120, 419, 420, 126, 421, 135, 422, 423, 424, 425, 426, 427, 144, 147, 148, 428, 429, 171, 185, 188, 430, 431, 369, 432, 433, 434, 435, 436, 202, 203, 205, 437, 438, 207, 439, 440, 215, 441, 442, 218, 380, 221, 443, 444, 287, 227, 228, 445, 237, 446, 249, 447, 448, 449, 450, 451, 452, 453, 258, and 261.

According to some embodiments of the invention, the abiotic stress promoter is a promoter which is active under a drought stress. Non-limiting examples of drought stress related promoters which can be used according to some embodiments of the invention include the promoter sequences set forth by SEQ ID NOs: 55, 454, 56, 58, 59, 60, 61, 62, 63, 65, 68, 69, 405, 70, 73, 74, 75, 77, 455, 78, 456, 457, 458, 459, 79, 80, 81, 82, 83, 84, 85, 86, 87, 89, 90, 91, 92, 93, 95, 96, 97, 98, 99, 322, 410, 460, 461, 462, 463, 413, 102, 103, 104, 110, 112, 117, 118, 120, 121, 122, 125, 131, 133, 134, 135, 140, 142, 143, 144, 147, 464, 148, 149, 465, 150, 466, 151, 467, 155, 156, 160, 161, 163, 166, 168, 428, 170, 172, 175, 178, 179, 181, 184, 186, 189, 191, 200, 201, 202, 203, 468, 469, 205, 437, 206, 470, 208, 30, 209, 211, 471, 212, 213, 214, 215, 441, 218, 380, 219, 472, 220, 473, 474, 475, 476, 443, 223, 477, 224, 478, 225, 227, 228, 229, 479, 230, 231, 232, 233, 480, 234, 237, 238, 239, 240, 244, 245, 246, 481, 248, 249, 448, 482, 483, 449, 450, 250, 253, 254, 255, 451, 452, 484, 485, 257, 258, 259, 260, 486, 261, 263, 264, 487, 265, and 266.

According to some embodiments of the invention, the abiotic stress promoter is a promoter which is active under a light stress.

As used herein the phrases "light stress" or "photoinhibition" which are interchangeably used herein, refer to a light intensity which causes inhibition of photosynthesis and optionally inhibition of biomass production and plant growth.

Normal light conditions may differ from one plant species to another and such conditions are well known in the art. For example, for tobacco, a normal light intensity is about 250 µmol m$^{-2}$ s$^{-1}$. For *Arabidopsis*, a normal light intensity is about 100 µmol m$^{-2}$ s$^{-1}$. A light stress in *Arabidopsis* can be achieved by exposing plants for a light intensity of 1,000 µmol m$^{-2}$ s$^{-1}$ for 1 hour.

Non-limiting examples of light stress related promoters which can be used according to some embodiments of the invention include the promoter sequences set forth by SEQ ID NOs:584, 585, 586, 587, 588, 589, 395, 590, 233, 591, 592, 593, 594, 595, 596, 597, 598, 599, 314, 600, 601, 602, 603, 604, 605, 606, 607, 442, 608, 609, 610, 611, 612, 613, 614, and 615.

According to some embodiments of the invention, the abiotic stress promoter is a promoter which is active under an osmotic stress. Non-limiting examples of osmotic stress related promoters which can be used according to some embodiments of the invention include the promoter sequences set forth by SEQ ID NOs: 616, 617, 618, 619, 393, 620, 386, 621, 622, 376, 623, 624, 625, 626, 627, 628, 403, 629, 630, 631, 632, 633, 410, 634, 635, 385, 368, 636, 387, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666, 221, 667, and 668.

According to some embodiments of the invention, the stress-related promoter is a promoter which is induced by ABA (an ABA induced promoter). Non-limiting examples of ABA-related promoters which can be used according to some embodiments of the invention include the promoter sequences set forth by SEQ ID NOs: 55, 488, 489, 56, 490, 57, 59, 60, 61, 491, 64, 65, 492, 68, 493, 69, 405, 70, 71, 72, 73, 74, 75, 78, 494, 457, 495, 458, 496, 459, 301, 80, 497, 82, 83, 85, 86, 407, 89, 90, 91, 92, 93, 95, 96, 97, 409, 99, 498, 460, 461, 462, 413, 102, 104, 105, 106, 499, 500, 108, 501, 111, 502, 113, 503, 114, 504, 505, 418, 506, 118, 119, 120, 121, 507, 122, 123, 508, 509, 510, 511, 125, 126, 127, 512, 421, 513, 514, 515, 516, 131, 134, 517, 518, 519, 520, 521, 522, 523, 136, 139, 145, 146, 524, 147, 464, 525, 149, 150, 151, 152, 526, 159, 160, 161, 527, 162, 163, 528, 165, 168, 428, 529, 429, 530, 171, 172, 176, 178, 179, 531, 181, 532, 533, 188, 534, 189, 190, 194, 196, 535, 536, 537, 367, 538, 203, 204, 468, 469, 539, 205, 540, 541, 437, 438, 206, 207, 542, 439, 543, 544, 30, 209, 545, 211, 471, 212, 546, 547, 548, 549, 550, 442, 218, 380, 551, 472, 552, 553, 554, 555, 473, 556, 557, 221, 474, 476, 222, 443, 477, 224, 558, 559, 478, 225, 226, 227, 228, 229, 479, 230, 231, 232, 560, 233, 561, 480, 562, 234, 235, 236, 563, 564, 238, 239, 241, 242, 243, 565, 566, 244, 245, 481, 567, 247, 568, 569, 248, 249, 482, 570, 483, 449, 571, 250, 251, 572, 573, 574, 253, 254, 575, 576, 577, 578, 256, 451, 579, 452, 484, 485, 580, 257, 259, 581, 260, 582, 583, 262, 264, and 265.

According to some embodiments of the invention, the stress related promoter is not the Senescence-Associated Receptor Kinase (SARK) promoter.

According to some embodiments of the invention, the nucleic acid construct comprising a polynucleotide encoding adenosine phosphate-isopentenyltransferase (IPT) operably linked to a Metallothionein (MT) promoter.

As used herein the term "Metallothionein" refers to a family of genes encoding cysteine-rich, low molecular weight proteins which bind heavy metals through the thiol group of their cysteine (Cys) residues. Metallothioneins are present in a variety of organisms including bacteria, fungi and all eukaryotic plant and animal species.

In several plants, the expression level of Metallothioneins is induced under a variety of abiotic stresses [e.g., drought, low temperature, nutrient deprivation, metal stress (e.g., Cadmium (Cd), ammonium, Cupper (Cu) or Zink (Zn)) and following treatment with ABA (Clement., et al., 2008, Supra) or Ethylene, and during senescence (Gepstein et al., 2003, Supra).

Non-limiting examples of metallothionein promoters which can be used in the nucleic acid construct of some embodiments of the invention include the following promoter sequences: the promoter of metallothionein-like family 15 protein AT2G23240, which comprises SEQ ID NO:686 (chr2:9896326-9899325 REVERSE); the promoter of *Arabidopsis thaliana* plant EC metallothionein-like family 15 protein (MT2A, METALLOTHIONEIN 2A) AT3G09390 which comprises SEQ ID NO:687 (chr3: 2890189-2893188 REVERSE); the promoter of MT2B (METALLOTHIONEIN 2B) AT5G02380 which comprises SEQ ID NO:688 (chr5:507165-510164 REVERSE); the promoter of metallothionein) AT2G42000 plant EC metallothionein-like family 15 protein [*Arabidopsis thaliana*] NC_003071.7 (17529243.17529828, complement) which comprises SEQ ID NO:689 (chr2:17529829-17532828 REVERSE); LOC100283577 metallothionein-like protein type 2 [*Zea mays*]; the promoter of MT1A (METALLOTHIONEIN 1A) copper ion binding/metal ion binding [*Arabidopsis thaliana*] NC_003070.9 (2338904.2339321, complement) which comprises SEQ ID NO:690 (AT1G07600, chr1:2339322-2342321 REVERSE); the promoter of MT3 (METALLOTHIONEIN 3) copper ion binding [*Arabidopsis thaliana*] NC_003074.8 (5180667.5181400, complement) which comprises SEQ ID NO:691 (AT3G15353, chr3: 5181326-5184325 REVERSE); the promoter of mt12 metallothionein2 *Zea mays* (GenBank Accession No. 557628) which comprises SEQ ID NO:692.

According to some embodiments of the invention the metallothionein promoter is as set forth by nucleotides 57-1208 of SEQ ID NO:1.

According to some embodiments of the invention, the metallothionein (MT) promoter is set forth by SEQ ID NO:693.

According to some embodiments of the invention, the stress related promoter sequences of some embodiments of the invention are modified to create variations in the molecule sequences such as to enhance their promoting activities, using methods known in the art, such as PCR-based DNA modification, or standard DNA mutagenesis techniques, or by chemically synthesizing the modified polynucleotides.

Accordingly, the stress related promoter sequences of some embodiments of the invention may be truncated or deleted and still retain the capacity of directing the transcription of an operably linked DNA sequence in the host cell. The minimal length of a promoter region can be determined by systematically removing sequences from the 5' and 3'-ends of the isolated polynucleotide by standard techniques known in the art, including but not limited to removal of restriction enzyme fragments or digestion with nucleases.

According to some embodiments of the invention, the nucleic acid construct of the invention comprises a functional portion of any of the above described promoter sequences.

As used herein the phrase "functional portion" refers to a minimal nucleic acid sequence which is capable of upregulating (i.e., increasing) transcription of a heterologous sequence under the stress condition.

According to some embodiments of the invention the functional portion includes at least 5, at least 6, at least 7, at least 8, at least 9, at least 10, at least 11, at least 12, at least 13, at least 14, at least 15, at least 16, at least 17, at least 18, at least 19, at least 20, at least about 25, at least about 30, at least about 35, at least about 40, at least about 45, at least about 50, at least about 55 consecutive nucleotides of the stress-related promoter sequence.

Assays for qualifying the ability of candidate functional portion sequences or truncated, deleted or mutated promoter sequences to regulate transcription of a heterologous sequence in a stress-related manner (i.e., to upregulate the transcription of the heterologous sequence under a stress condition) are known in the art (see e.g., Yasunari Fujita, Mild Fujita, Rie Satoh, et al. 2005. AREB1 Is a Transcription Activator of Novel ABRE-Dependent ABA Signaling That Enhances Drought Stress Tolerance in *Arabidopsis*. The plant cell 17:3470-3488; which is fully incorporated herein by reference). For example, the candidate sequence can be placed upstream of a reporter gene in a nucleic acid construct which is transformed into a plant, and the plant is grown under stress or non-stress (e.g., optimal) conditions. The expression level of the reporter gene is monitored under the various conditions and compared between transgenic and non-transgenic plants, and/or between transgenic planted transformed with a nucleic acid construct which comprises the candidate functional portion upstream of the reporter gene and transgenic plants transformed with a nucleic acid construct which comprises a known stress-related promoter upstream of a reporter gene. Examples of known reporter genes which can be used by such assays include, but are not limited to, GUS, luciferase, and GFP (green fluorescent protein).

In another approach, novel hybrid promoters can be designed or engineered by a number of methods. Many promoters contain upstream sequences which activate, enhance or define the strength and/or specificity of the promoter, such as described, for example, by Atchison [Ann Rev. Cell Biol. 4:127 (1988)]. T-DNA genes, for example contain "TATA" boxes defining the site of transcription initiation and other upstream elements located upstream of the transcription initiation site modulate transcription levels [Gelvin In: Transgenic Plants (Kung, S.-D. and Us, R., eds, San Diego: Academic Press, pp. 49-87, (1988)]. Another chimeric promoter combined a trimer of the octopine synthase (ocs) activator to the mannopine synthase (mas) activator plus promoter and reported an increase in expression of a reporter gene [Min Ni et al., The Plant Journal 7:661 (1995)]. The stress-related promoter of some embodiments of the invention can be used for the construction of such chimeric or hybrid promoters. Methods for construction of variant promoters include, but are not limited to, combining control elements of different promoters or duplicating portions or regions of a promoter (see for example, U.S. Pat. Nos. 5,110,732 and 5,097,025). Those of skill in the art are familiar with the specific conditions and procedures for the construction, manipulation and isolation of macromolecules (e.g., DNA molecules, plasmids, etc.), generation of recombinant organisms and the screening and isolation of genes, [see for example Sambrook et al., Molecular Cloning: A Laboratory Manual, Cold Spring Harbor Press, (1989); Mailga et al., Methods in Plant Molecular Biology, Cold Spring Harbor Press, (1995); Birren et al., Genome Analysis: volume 1, Analyzing DNA, (1997); volume 2, Detecting Genes, (1998); volume 3, Cloning Systems, (1999); and volume 4, Mapping Genomes, (1999), Cold Spring Harbor, N.Y].

The nucleic acid construct according to some embodiments of the invention further comprises a transcription terminator placed downstream of the IPT coding sequence. Non-limiting examples of such terminators include the NOS terminator, a regulatory sequence from the nopalin-synthase-gene from *Agrobacterium tumefaciens* (e.g., nucleotides 2075-2328 of SEQ ID NO:1), and ocs3 terminator (octopine synthase terminator; SEQ ID NO:695), mas3 terminator mannopine synthesis terminator (SEQ ID NO:696).

According to some embodiments of the invention, the nucleic acid construct comprises the nucleic acid sequence set forth by SEQ ID NO:1.

The nucleic acid construct of some embodiments of the invention can further include an appropriate selectable marker and/or an origin of replication. According to some embodiments of the invention, the nucleic acid construct utilized is a shuttle vector, which can propagate both in *E. coli* (wherein the construct comprises an appropriate selectable marker and origin of replication) and be compatible with propagation in cells. The construct according to the present invention can be, for example, a plasmid, a bacmid, a phagemid, a cosmid, a phage, a virus or an artificial chromosome.

The nucleic acid construct of some embodiments of the invention can be utilized to transform a host cell. Non-limiting examples of host cells which can be used along with some embodiments of the invention include plant cells, bacterial cells (e.g., *agrobacteria*), and animal cells.

According to some embodiments of the invention, the host cell is a plant cell.

According to some embodiments of the invention, the plant cell forms part of a plant.

According to an aspect of some embodiments of the invention, there is provided a method of producing a transgenic plant, comprising expressing within the plant the nucleic acid construct of some embodiments of the invention.

The phrase "expressing within the plant" as used herein refers to upregulating the expression level within the plant of the exogenous polynucleotide comprised in the nucleic acid construct, by introducing the nucleic acid construct into a plant cell or a plant and expressing by recombinant means, as further described herein below.

As used herein "expressing" refers to expression at the mRNA and optionally polypeptide level.

The phrase "exogenous polynucleotide" refers to any nucleic acid sequence which is not naturally expressed within the plant and/or which overexpression in the plant is desired. The exogenous polynucleotide may be an isolated single or double stranded nucleic acid sequence in the form of an RNA sequence, a complementary polynucleotide sequence (cDNA), a genomic polynucleotide sequence and/or a composite polynucleotide sequences (e.g., a combination of the above).

The exogenous polynucleotide may comprise a nucleic acid sequence which is identical or partially homologous to an endogenous nucleic acid sequence of the plant.

The term "endogenous" as used herein refers to any polynucleotide or polypeptide which is present and/or naturally expressed within a plant or a cell thereof.

The term "isolated" as used herein refers to at least partially separated from the natural environment e.g., from a plant cell.

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

As used herein the phrase "genomic polynucleotide sequence" refers to a sequence derived (isolated) from a chromosome and thus it represents a contiguous portion of a chromosome.

As used herein the phrase "composite polynucleotide sequence" refers to a sequence, which is at least partially complementary and at least partially genomic. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

The nucleic acid sequences of some embodiments of the invention (e.g., the polynucleotides encoding IPT and/or the stress-related promoter sequences) may be optimized for plant expression. Examples of such sequence modifications include, but are not limited to, an altered G/C content to more closely approach that typically found in the plant species of interest, and the removal of codons atypically found in the plant species commonly referred to as codon optimization.

The phrase "codon optimization" refers to the selection of appropriate DNA nucleotides for use within a structural gene or fragment thereof that approaches codon usage within the plant of interest. Therefore, an optimized gene or nucleic acid sequence refers to a gene in which the nucleotide sequence of a native or naturally occurring gene has been modified in order to utilize statistically-preferred or statistically-favored codons within the plant. The nucleotide sequence typically is examined at the DNA level and the coding region optimized for expression in the plant species determined using any suitable procedure, for example as described in Sardana et al. (1996, Plant Cell Reports 15:677-681). In this method, the standard deviation of codon usage, a measure of codon usage bias, may be calculated by first finding the squared proportional deviation of usage of each codon of the native gene relative to that of highly expressed plant genes, followed by a calculation of the average squared deviation. The formula used is: $1 SDCU = n=1 N [(X_n - Y_n)/Y_n]2/N$, where $X_n$ refers to the frequency of usage of codon n in highly expressed plant genes, where $Y_n$ to the frequency of usage of codon n in the gene of interest and N refers to the total number of codons in the gene of interest. A Table of codon usage from highly expressed genes of dicotyledonous plants is compiled using the data of Murray et al. (1989, Nuc Acids Res. 17:477-498).

One method of optimizing the nucleic acid sequence in accordance with the preferred codon usage for a particular plant cell type is based on the direct use, without performing any extra statistical calculations, of codon optimization Tables such as those provided on-line at the Codon Usage Database through the NIAS (National Institute of Agrobiological Sciences) DNA bank in Japan [Hypertext Transfer Protocol://World Wide Web (dot) kazusa (dot) or (dot) jp/codon/]. The Codon Usage Database contains codon usage tables for a number of different species, with each codon usage table having been statistically determined based on the data present in GenBank.

By using the above Tables to determine the most preferred or most favored codons for each amino acid in a particular species (for example, rice), a naturally-occurring nucleotide sequence encoding a protein of interest can be codon optimized for that particular plant species. This is effected by replacing codons that may have a low statistical incidence in the particular species genome with corresponding codons, in regard to an amino acid, that are statistically more favored. However, one or more less-favored codons may be selected to delete existing restriction sites, to create new ones at potentially useful junctions (5' and 3' ends to add signal peptide or termination cassettes, internal sites that might be used to cut and splice segments together to produce a correct full-length sequence), or to eliminate nucleotide sequences that may negatively effect mRNA stability or expression.

The naturally-occurring encoding nucleotide sequence may already, in advance of any modification, contain a number of codons that correspond to a statistically-favored codon in a particular plant species. Therefore, codon optimization of the native nucleotide sequence may comprise determining which codons, within the native nucleotide sequence, are not statistically-favored with regards to a particular plant, and modifying these codons in accordance with a codon usage table of the particular plant to produce a codon optimized derivative. A modified nucleotide sequence may be fully or partially optimized for plant codon usage provided that the protein encoded by the modified nucleotide sequence is produced at a level higher than the protein encoded by the corresponding naturally occurring or native gene. Construction of synthetic genes by altering the codon usage is described in for example PCT Patent Application 93/07278.

Thus, according to some embodiments the invention encompasses nucleic acid sequences described hereinabove; fragments thereof, sequences homologous thereto, sequences orthologous thereto, sequences encoding similar polypeptides with different codon usage, altered sequences characterized by mutations, such as deletion, insertion or substitution of one or more nucleotides, either naturally occurring or man induced, either randomly or in a targeted fashion.

Polynucleotides and polypeptides of the present invention are used for plant expression.

The term "plant" as used herein encompasses whole plants, ancestors and progeny of the plants and plant parts, including seeds, shoots, stems, roots (including tubers), and plant cells, tissues and organs. The term "plant" also therefore encompasses suspension cultures, embryos, meristematic regions, callus tissue, leaves, gametophytes, sporophytes, pollen, and microspores. Plants that are particularly useful in the methods of the invention include all plants which belong to the superfamily Viridiplantae, in particular monocotyledonous and dicotyledonous plants which are of commercial value, including a fodder or forage legume, ornamental plant, food crop, tree, or shrub selected from the following non-limiting list comprising *Acacia* spp., *Acer* spp., *Actinidia* spp., *Aesculus* spp., *Agathis australis*, *Albizia amara*, *Alsophila tricolor*, *Andropogon* spp., *Arachis* spp, *Areca catechu*, *Astelia fragrans*, *Astragalus cicer*, *Baikiaea plurijuga*, *Betula* spp., *Brassica* spp., *Bruguiera gymnorrhiza*, *Burkea africana*, *Butea frondosa*, *Cadaba farinosa*, *Calliandra* spp, *Camella sinensis*, *Canna indica*, *Capsicum* spp., *Cassia* spp., *Cent roema pubescens*, *Chaenomeles* spp., *Cinnamomum cassia*, *Coffea arabica*, *Colophospermum mopane*, *Coronillia varia*, *Cotoneaster serotina*, *Crataegus* spp., *Cucumis* spp., *Cupressus* spp., *Cyathea dealbata*, *Cydonia oblonga*, *Ciyptomeria laponica*, *Cymbopogon* spp., *Cynthea dealbata*, *Cydonia oblonga*, *Dalbergia monetaria*, *Davalila divaricata*, *Desmodium* spp., *Dicksonia squarosa*, *Diheteropogon amplectens*, *Dioclea* spp, *Dolichos* spp., *Doiycnium rectum*, *Echinochloa pyramidalis*, *Ehrartia* spp., *Eleusine coracana*, *Era grestis* spp., *Erythrina* spp., *Eucalyptus* spp, *Euclea schimpen Eulalia villosa*, *Fagopyrum* spp., *Felloa sellowiana*, *Fragaria* spp., *Flemingia* spp, *Freycinetia banksii*, *Geranium thunbergi*, *Ginkgo biloba*, *Glycine javanica*, *Gliricidia* spp, *Gossypium hirsutum*, *Gre villea* spp., *Guibourtia coleosperma*, *Hedysarum* spp., *Hemarthia altissima*, *Heteropogon con tortus*, *Hordeum vulgare*, *Hyparrhenia rufa*, *Hypericum erectum*, *Hyperthelia dissoluta*, *Indigo incarnata*, *Iris* spp., *Jatropha curcas*, *Leptarrhena pyrolifolia*, *Lespediza* spp., *Lettuca* spp., *Leucaena leucocephala*, *Loudetia simplex*, *Lotonus bainesi*, *Lotus* spp., *Macrotyloma axifiare*, *Malus* spp., *Manihot esculenta*, *Medicago sativa*, *Metasequoia glyptostroboides*, *Musa sapientum*, *Nicotianum* spp., *Onobtychis* spp., *Ornithopus* spp., *Oryza* spp., *Peltophorum african urn*, *Pennisetum* spp., *Persea gratissima*, *Petunia* spp., *Phaseolus* spp., *Phoenix canariensis*, *Phormium cookianum*, *Photinia* spp., *Picea glauca*, *Pinus* spp., *Pisum sativum*, *Podocarpus totara*, *Pogonarthria flecki*, *Pogonarthria squarrosa*, *Populus* spp., *Prosopis cineraria*, *Pseudotsuga menziesi*, *Pterolobium stellatum*, *Pyrus communis*, *Quercus* spp., *Rhaphiolepsis umbellata*, *Rhopalostylis sapida*, *Rhu.s natalensis*, *Ribes grossularia*, *Ribes* spp., *Robinia pseudoacacia*, *Rosa* spp., *Rub us* spp., *Salix* spp., *Schyzachyrium sanguineurn*, *Sciadopitys verticillata*, *Sequoia sempen'irens*, *Sequoiadendron giganteum*, *Sorghum bicolor*, *Spinacia* spp., *Sporobolus fimbriatus*, *Stiburus alopecuroides*, *Stylosanthos humilis*, *Tadehagi* spp, *Taxodium distichum*, *Themeda triandra*, *Trifollum* spp., *Triticum* spp., *Tsuga heterophylla*, *Vaccinium* spp., *Vicia* spp., *Vitis vinifera*, *Watsonia pyramidata*, *Zantedeschia aethiopica*, *Zea mays*, amaranth, artichoke, asparagus, broccoli, Brussels sprouts, cabbage, canola, carrot, cauliflower, celery, collard greens, flax, kale, lentil, oilseed rape, okra, onion, potato, rice, soybean, straw, sugar beet, sugar cane, sunflower, tomato, squash tea, trees. Alternatively algae and other non-Viridiplantae can be used.

The nucleic acid construct of the present invention can be utilized to stably or transiently transform plant cells. In stable transformation, the exogenous polynucleotide of the present invention is integrated into the plant genome and as such it represents a stable and inherited trait. In transient transformation, the exogenous polynucleotide is expressed by the cell transformed but it is not integrated into the genome and as such it represents a transient trait.

There are various methods of introducing foreign genes into both monocotyledonous and dicotyledonous plants (Potrykus, I., Annu. Rev. Plant. Physiol., Plant. Mol. Biol. (1991) 42:205-225; Shimamoto et al., Nature (1989) 338: 274-276).

The principle methods of causing stable integration of exogenous DNA into plant genomic DNA include two main approaches:

(i) *Agrobacterium*-mediated gene transfer: Klee et al. (1987) Annu. Rev. Plant Physiol. 38:467-486; Klee and Rogers in Cell Culture and Somatic Cell Genetics of Plants, Vol. 6, Molecular Biology of Plant Nuclear Genes, eds. Schell, J., and Vasil, L. K., Academic Publishers, San Diego, Calif. (1989) p. 2-25; Gatenby, in Plant Biotechnology, eds. Kung, S, and Arntzen, C. J., Butterworth Publishers, Boston, Mass. (1989) p. 93-112.

(ii) Direct DNA uptake: Paszkowski et al., in Cell Culture and Somatic Cell Genetics of Plants, Vol. 6, Molecular Biology of Plant Nuclear Genes eds. Schell, J., and Vasil, L. K., Academic Publishers, San Diego, Calif. (1989) p. 52-68; including methods for direct uptake of DNA into protoplasts, Toriyama, K. et al. (1988) Bio/Technology 6:1072-1074. DNA uptake induced by brief electric shock of plant cells: Zhang et al. Plant Cell Rep. (1988) 7:379-384. Fromm et al. Nature (1986) 319:791-793. DNA injection into plant cells or tissues by particle bombardment, Klein et al. Bio/Technology (1988) 6:559-563; McCabe et al. Bio/Technology (1988) 6:923-926; Sanford, Physiol. Plant. (1990) 79:206-209; by the use of micropipette systems: Neuhaus et al., Theor. Appl. Genet. (1987) 75:30-36; Neuhaus and Spangenberg, Physiol. Plant. (1990) 79:213-217; glass fibers or silicon carbide whisker transformation of cell cultures, embryos or callus tissue, U.S. Pat. No. 5,464,765 or by the direct incubation of DNA with germinating pollen, DeWet et al. in Experimental Manipulation of Ovule Tissue, eds. Chapman, G. P. and Mantell, S. H. and Daniels, W. Longman, London, (1985) p. 197-209; and Ohta, Proc. Natl. Acad. Sci. USA (1986) 83:715-719.

The *Agrobacterium* system includes the use of plasmid vectors that contain defined DNA segments that integrate into the plant genomic DNA. Methods of inoculation of the plant tissue vary depending upon the plant species and the *Agrobacterium* delivery system. A widely used approach is the leaf disc procedure which can be performed with any tissue explant that provides a good source for initiation of whole plant differentiation. Horsch et al. in Plant Molecular Biology Manual A5, Kluwer Academic Publishers, Dordrecht (1988) p. 1-9. A supplementary approach employs the *Agrobacterium* delivery system in combination with vacuum infiltration. The *Agrobacterium* system is especially viable in the creation of transgenic dicotyledonous plants.

There are various methods of direct DNA transfer into plant cells. In electroporation, the protoplasts are briefly exposed to a strong electric field. In microinjection, the DNA is mechanically injected directly into the cells using very small micropipettes. In microparticle bombardment, the DNA is adsorbed on microprojectiles such as magnesium sulfate crystals or tungsten particles, and the microprojectiles are physically accelerated into cells or plant tissues.

Following stable transformation plant propagation is exercised. The most common method of plant propagation is by seed. Regeneration by seed propagation, however, has the deficiency that due to heterozygosity there is a lack of uniformity in the crop, since seeds are produced by plants according to the genetic variances governed by Mendelian rules. Basically, each seed is genetically different and each will grow with its own specific traits. Therefore, it is preferred that the transformed plant be produced such that the regenerated plant has the identical traits and characteristics of the parent transgenic plant. Therefore, it is preferred that the transformed plant be regenerated by micropropagation which provides a rapid, consistent reproduction of the transformed plants.

Micropropagation is a process of growing new generation plants from a single piece of tissue that has been excised from a selected parent plant or cultivar. This process permits the mass reproduction of plants having the preferred tissue expressing the fusion protein. The new generation plants which are produced are genetically identical to, and have all of the characteristics of, the original plant. Micropropagation allows mass production of quality plant material in a short period of time and offers a rapid multiplication of selected cultivars in the preservation of the characteristics of the original transgenic or transformed plant. The advantages of cloning plants are the speed of plant multiplication and the quality and uniformity of plants produced.

Micropropagation is a multi-stage procedure that requires alteration of culture medium or growth conditions between stages. Thus, the micropropagation process involves four basic stages: Stage one, initial tissue culturing; stage two, tissue culture multiplication; stage three, differentiation and plant formation; and stage four, greenhouse culturing and hardening. During stage one, initial tissue culturing, the tissue culture is established and certified contaminant-free. During stage two, the initial tissue culture is multiplied until a sufficient number of tissue samples are produced to meet production goals. During stage three, the tissue samples grown in stage two are divided and grown into individual plantlets. At stage four, the transformed plantlets are transferred to a greenhouse for hardening where the plants' tolerance to light is gradually increased so that it can be grown in the natural environment.

According to some embodiments of the invention, mature transformed plants generated as described above are further selected for the trait of interest (e.g., improved FUE, stress tolerance etc.). Examples of such screening assays are provided hereinbelow and in the Examples section which follows. Thus, for example, transgenic plants may be screened for improved nutritional value (e.g., improved oil, amino acids and/or protein content, as well as N content per se) under normal or stress conditions as will be further described hereinbelow. Alternatively or additionally, transformed and non-transformed (wild type) plants are exposed to an abiotic stress condition, such as water depravation, suboptimal temperature, nutrient deficiency, or preferably a salt stress condition. Salt stress can be effected in many ways such as, for example, by irrigating the plants with a hyperosmotic solution, by cultivating the plants hydroponically in a hyperosmotic growth solution (e.g., Hoagland solution), or by culturing the plants in a hyperosmotic growth medium (e.g., MS medium). Since different plants vary considerably in their tolerance to salinity, the salt concentration in the irrigation water, growth solution, or growth medium is preferably adjusted according to the specific characteristics of the specific plant cultivar or variety, so as to inflict a mild or moderate effect on the physiology and/or morphology of the plants (for guidelines as to appropriate concentration please see, Bernstein and Kafkafi, Root Growth Under Salinity Stress In: Plant Roots, The Hidden Half 3rd ed. Waisel Y, Eshel A and Kafkafi U. (editors) Marcel Dekker Inc., New York, 2002, and reference therein). Following exposure to the stress condition the plants are frequently monitored until substantial physiological and/or morphological effects appear in wild type plants. Subsequently, transformed plants not exhibiting substantial physiological and/or morphological effects, or exhibiting higher biomass than wild-type plants, are identified as abiotic stress tolerant plants.

According to some embodiments of the invention, the transformation is stable transformation.

According to some embodiments of the invention, the transformation is transient transformation. Such a transformation can be to leaf cells, meristematic cells or the whole plant.

Transient transformation can be effected by any of the direct DNA transfer methods described above or by viral infection using modified plant viruses.

Viruses that have been shown to be useful for the transformation of plant hosts include CaMV, TMV and BV. Transformation of plants using plant viruses is described in U.S. Pat. No. 4,855,237 (BGV), EP-A 67,553 (TMV), Japanese Published Application No. 63-14693 (TMV), EPA 194,809 (BV), EPA 278,667 (BV); and Gluzman, Y. et al., Communications in Molecular Biology: Viral Vectors, Cold Spring Harbor Laboratory, New York, pp. 172-189 (1988). Pseudovirus particles for use in expressing foreign DNA in many hosts, including plants, are described in WO 87/06261.

Preferably, the virus of the present invention is avirulent and thus is incapable of causing severe symptoms such as reduced growth rate, mosaic, ring spots, leaf roll, yellowing, streaking, pox formation, tumor formation and pitting. A suitable avirulent virus may be a naturally occurring avirulent virus or an artificially attenuated virus. Virus attenuation may be effected by using methods well known in the art including, but not limited to, sub-lethal heating, chemical treatment or by directed mutagenesis techniques such as described, for example, by Kurihara and Watanabe (Molecular Plant Pathology 4:259-269, 2003), Gal-on et al. (1992), Atreya et al. (1992) and Huet et al. (1994).

Suitable virus strains can be obtained from available sources such as, for example, the American Type culture Collection (ATCC) or by isolation from infected plants. Isolation of viruses from infected plant tissues can be effected by techniques well known in the art such as described, for example by Foster and Tatlor, Eds. "Plant Virology Protocols From Virus Isolation to Transgenic Resistance (Methods in Molecular Biology (Humana Pr), Vol 81)", Humana Press, 1998. Briefly, tissues of an infected plant believed to contain a high concentration of a suitable virus, preferably young leaves and flower petals, are ground in a buffer solution (e.g., phosphate buffer solution) to produce a virus infected sap which can be used in subsequent inoculations.

Construction of plant RNA viruses for the introduction and expression of non-viral exogenous polynucleotide sequences in plants is demonstrated by the above references as well as by Dawson, W. O. et al., Virology (1989) 172:285-292; Takamatsu et al. EMBO J. (1987) 6:307-311; French et al. Science (1986) 231:1294-1297; and Takamatsu et al. FEBS Letters (1990) 269:73-76.

When the virus is a DNA virus, suitable modifications can be made to the virus itself. Alternatively, the virus can first be cloned into a bacterial plasmid for ease of constructing the desired viral vector with the foreign DNA. The virus can then be excised from the plasmid. If the virus is a DNA virus, a bacterial origin of replication can be attached to the viral DNA, which is then replicated by the bacteria. Transcription and translation of this DNA will produce the coat protein which will encapsidate the viral DNA. If the virus is an RNA virus, the virus is generally cloned as a cDNA and inserted into a plasmid. The plasmid is then used to make all of the constructions. The RNA virus is then produced by transcribing the viral sequence of the plasmid and translation of the viral genes to produce the coat protein(s) which encapsidate the viral RNA.

Construction of plant RNA viruses for the introduction and expression in plants of non-viral exogenous polynucleotide sequences such as those included in the construct of the present invention is demonstrated by the above references as well as in U.S. Pat. No. 5,316,931.

In one embodiment, a plant viral polynucleotide is provided in which the native coat protein coding sequence has been deleted from a viral polynucleotide, a non-native plant viral coat protein coding sequence and a non-native promoter, preferably the subgenomic promoter of the non-native coat protein coding sequence, capable of expression in the plant host, packaging of the recombinant plant viral polynucleotide, and ensuring a systemic infection of the host by the recombinant plant viral polynucleotide, has been inserted. Alternatively, the coat protein gene may be inactivated by insertion of the non-native polynucleotide sequence within it, such that a protein is produced. The recombinant plant viral polynucleotide may contain one or more additional non-native subgenomic promoters. Each non-native subgenomic promoter is capable of transcribing or expressing adjacent genes or polynucleotide sequences in the plant host and incapable of recombination with each other and with native subgenomic promoters. Non-native (foreign) polynucleotide sequences may be inserted adjacent the native plant viral subgenomic promoter or the native and a non-native plant viral subgenomic promoters if more than one polynucleotide sequence is included. The non-native polynucleotide sequences are transcribed or expressed in the host plant under control of the subgenomic promoter to produce the desired products.

In a second embodiment, a recombinant plant viral polynucleotide is provided as in the first embodiment except that the native coat protein coding sequence is placed adjacent one of the non-native coat protein subgenomic promoters instead of a non-native coat protein coding sequence.

In a third embodiment, a recombinant plant viral polynucleotide is provided in which the native coat protein gene is adjacent its subgenomic promoter and one or more non-native subgenomic promoters have been inserted into the viral polynucleotide. The inserted non-native subgenomic promoters are capable of transcribing or expressing adjacent genes in a plant host and are incapable of recombination with each other and with native subgenomic promoters. Non-native polynucleotide sequences may be inserted adjacent the non-native subgenomic plant viral promoters such that the sequences are transcribed or expressed in the host plant under control of the subgenomic promoters to produce the desired product.

In a fourth embodiment, a recombinant plant viral polynucleotide is provided as in the third embodiment except that the native coat protein coding sequence is replaced by a non-native coat protein coding sequence.

The viral vectors are encapsidated by the coat proteins encoded by the recombinant plant viral polynucleotide to produce a recombinant plant virus. The recombinant plant viral polynucleotide or recombinant plant virus is used to infect appropriate host plants. The recombinant plant viral polynucleotide is capable of replication in the host, systemic spread in the host, and transcription or expression of foreign gene(s) (exogenous polynucleotide) in the host to produce the desired protein.

Techniques for inoculation of viruses to plants may be found in Foster and Taylor, eds. "Plant Virology Protocols: From Virus Isolation to Transgenic Resistance (Methods in Molecular Biology (Humana Pr), Vol 81)", Humana Press, 1998; Maramorosh and Koprowski, eds. "Methods in Virology" 7 vols, Academic Press, New York 1967-1984; Hill, S. A. "Methods in Plant Virology", Blackwell, Oxford, 1984; Walkey, D. G. A. "Applied Plant Virology", Wiley, New York, 1985; and Kado and Agrawa, eds. "Principles and Techniques in Plant Virology", Van Nostrand-Reinhold, New York.

In addition to the above, the polynucleotide of the present invention can also be introduced into a chloroplast genome thereby enabling chloroplast expression.

A technique for introducing exogenous polynucleotide sequences to the genome of the chloroplasts is known. This technique involves the following procedures. First, plant cells are chemically treated so as to reduce the number of chloroplasts per cell to about one. Then, the exogenous polynucleotide is introduced via particle bombardment into the cells with the aim of introducing at least one exogenous polynucleotide molecule into the chloroplasts. The exogenous polynucleotides selected such that it is integratable into the chloroplast's genome via homologous recombination which is readily effected by enzymes inherent to the chloroplast. To this end, the exogenous polynucleotide includes, in addition to a gene of interest, at least one polynucleotide stretch which is derived from the chloroplast's genome. In addition, the exogenous polynucleotide includes a selectable marker, which serves by sequential selection procedures to ascertain that all or substantially all of the copies of the chloroplast genomes following such selection will include the exogenous polynucleotide. Further details relating to this technique are found in U.S. Pat. Nos. 4,945,050; and 5,693,507 which are incorporated herein by reference. A polypeptide can thus be produced by the protein expression system of the chloroplast and become integrated into the chloroplast's inner membrane.

Since the traits of the present invention (e.g., abiotic stress tolerance) in plants can involve multiple genes acting additively or in synergy (see, for example, in Quesda et al., Plant Physiol. 130:951-063, 2002), the present invention also envisages expressing a plurality of exogenous polynucleotides in a single host plant to thereby achieve superior abiotic stress tolerance, biomass and/or yield.

Expressing a plurality of exogenous polynucleotides in a single host plant can be effected by co-introducing multiple nucleic acid constructs, each including a different exogenous polynucleotide, into a single plant cell. The transformed cell can then be regenerated into a mature plant using the methods described hereinabove.

Alternatively, expressing a plurality of exogenous polynucleotides in a single host plant can be effected by co-introducing into a single plant-cell a single nucleic-acid construct including a plurality of different exogenous polynucleotides. Such a construct can be designed with a single promoter sequence which can transcribe a polycistronic message including all the different exogenous polynucleotide sequences. To enable co-translation of the different polypeptides encoded by the polycistronic message, the polynucleotide sequences can be inter-linked via an internal ribosome entry site (IRES) sequence which facilitates translation of polynucleotide sequences positioned downstream of the IRES sequence. In this case, a transcribed polycistronic RNA molecule encoding the different polypeptides described above will be translated from both the capped 5' end and the two internal IRES sequences of the polycistronic RNA molecule to thereby produce in the cell all different polypeptides. Alternatively, the construct can include several promoter sequences each linked to a different exogenous polynucleotide sequence.

The plant cell transformed with the construct including a plurality of different exogenous polynucleotides, can be regenerated into a mature plant, using the methods described hereinabove.

Alternatively, expressing a plurality of exogenous polynucleotides in a single host plant can be effected by introducing different nucleic acid constructs, including different exogenous polynucleotides, into a plurality of plants. The regenerated transformed plants can then be cross-bred and resultant progeny selected for superior traits such as NUE, abiotic stress tolerance and/or biomass, using conventional plant breeding techniques.

Thus, according to an aspect of some embodiments of the invention, there is provided a transgenic plant comprising the nucleic acid construct of some embodiments of the invention, or the host cell of some embodiments of the invention.

According to some embodiments of the invention, the transgenic plant exogenously expresses the nucleic acid construct of some embodiments of the invention.

As mentioned above and described in Examples 1-2 of the Examples section which follows, transgenic plants overexpressing the nucleic acid construct according to some embodiments of the invention exhibit increased tolerance and/or resistance to various abiotic stresses.

Thus, according to an aspect of some embodiments of the invention there is provided a method of increasing abiotic stress tolerance (ABST) of a plant. The method is effected by expressing within the plant the nucleic acid construct of some embodiments of the invention, thereby increasing the abiotic stress tolerance of the plant.

As used herein the term "increasing" refers to improving or increasing the trait of the transgenic plant of some embodiments of the invention by at least about 2% more, about 3% more, about 4% more, about 5% more, about 10% more, about 20% more, about 30% more, about 40% more, about 50% more, about 60% more, about 70% more, about 80% more, about 90%, about 95%, about 99% more than that of the non-transgenic plant (e.g., mock transfected, naïve, wild type plant(s)).

As used herein the term "trait" refers to a characteristic or quality of a plant which may overall (either directly or indirectly) improve the commercial value of the plant.

The phrase "stress tolerance" as used herein refers to the ability of a plant to endure a stress (abiotic) without suffering a substantial alteration in metabolism, growth, productivity and/or viability.

According to some embodiments of the invention, the genetically engineered plant of the some embodiments of the invention exhibits at least about 2% more, about 3% more, about 4% more, about 5% more, about 10% more, about 20% more, about 30% more, about 40% more, about 50% more, about 60% more, about 70% more, about 80% more, about 90% more or even higher tolerance to abiotic stress than non-transgenic plants.

The phrase "abiotic stress" as used herein refers to any adverse effect on metabolism, growth, reproduction and/or viability of a plant. Accordingly, abiotic stress can be induced by suboptimal environmental growth conditions such as, for example, salinity, water deprivation, flooding, freezing, low or high temperature, heavy metal toxicity, anaerobiosis, nutrient deficiency, atmospheric pollution or UV irradiation. The implications of abiotic stress are discussed in the Background section.

According to some embodiments of the invention, the abiotic stress can be drought, cold stress, chilling stress, heat stress, salinity stress, osmotic stress, freeze stress, nutrient deficiency, heavy metal stress and/or any combinations thereof.

As used herein the phrase "water use efficiency (WUE)" refers to the level of organic matter produced per unit of water consumed by the plant, i.e., the dry weight of a plant in relation to the plant's water use, e.g., the biomass produced per unit transpiration.

As used herein the phrase "fertilizer use efficiency" refers to the metabolic process(es) which lead to an increase in the plant's yield, biomass, vigor, and growth rate per fertilizer unit applied. The metabolic process can be the uptake, spread, absorbent, accumulation, relocation (within the plant) and use of one or more of the minerals and organic moieties absorbed by the plant, such as nitrogen, phosphates and/or potassium.

As used herein the phrase "fertilizer-limiting conditions" refers to growth conditions which include a level (e.g., concentration) of a fertilizer applied which is below the level needed for normal plant metabolism, growth, reproduction and/or viability.

As used herein the phrase "nitrogen use efficiency (NUE)" refers to the metabolic process(es) which lead to an increase in the plant's yield, biomass, vigor, and growth rate per nitrogen unit applied. The metabolic process can be the uptake, spread, absorbent, accumulation, relocation (within the plant) and use of nitrogen absorbed by the plant.

As used herein the phrase "nitrogen-limiting conditions" refers to growth conditions which include a level (e.g., concentration) of nitrogen (e.g., ammonium or nitrate) applied which is below the level needed for normal plant metabolism, growth, reproduction and/or viability. Improved plant NUE and FUE is translated in the field into either harvesting similar quantities of yield, while implementing less fertilizers, or increased yields gained by implementing the same levels of fertilizers. Thus, improved NUE or FUE has a direct effect on plant yield in the field. Thus, the polynucleotides and polypeptides of some embodiments of the invention positively affect plant yield, seed yield, and plant biomass. In addition, the benefit of improved plant NUE will certainly improve crop quality and biochemical constituents of the seed such as protein yield and oil yield.

As used herein the term "increasing" refers to at least about 2%, at least about 3%, at least about 4%, at least about 5%, at least about 10%, at least about 15%, at least about 20%, at least about 30%, at least about 40%, at least about 50%, at least about 60%, at least about 70%, at least about 80%, increase in yield, growth rate, biomass, vigor, oil content, abiotic stress tolerance and/or nitrogen use efficiency of a plant as compared to a native plant, i.e., a plant not modified with the biomolecules (polynucleotide or polypeptides) of the invention, e.g., a non-transformed plant of the same species which is grown under the same growth conditions.

According to some embodiments of the invention, the method further comprising growing the plant under the abiotic stress.

Plants are subject to a range of environmental challenges. Several of these, including salt stress, general osmotic stress, drought stress and freezing stress, have the ability to impact whole plant and cellular water availability. Not surprisingly, then, plant responses to this collection of stresses are related. Zhu (2002) Ann. Rev. Plant Biol. 53: 247-273 et al. note that "most studies on water stress signaling have focused on salt stress primarily because plant responses to salt and drought are closely related and the mechanisms overlap". Many examples of similar responses and pathways to this set of stresses have been documented. For example, the CBF transcription factors have been shown to condition resistance to salt, freezing and drought (Kasuga et al. (1999) Nature Biotech. 17: 287-291). The *Arabidopsis* rd29B gene is induced in response to both salt and dehydration stress, a process that is mediated largely through an ABA signal transduction process (Uno et al. (2000) Proc. Natl. Acad. Sci. USA 97: 11632-11637), resulting in altered activity of transcription factors that bind to an upstream element within the rd29B promoter. In *Mesembryanthemum crystallinum* (ice plant), Patharker and Cushman have shown that a calcium-dependent protein kinase (McCDPK1) is induced by exposure to both drought and salt stresses (Patharker and Cushman (2000) Plant J. 24: 679-691). The stress-induced kinase was also shown to phosphorylate a transcription factor, presumably altering its activity, although transcript levels of the target transcription factor are not altered in response to salt or drought stress. Similarly, Saijo et al. demonstrated that a rice salt/drought-induced calmodulin-dependent protein kinase (OsCDPK7) conferred increased salt and drought tolerance to rice when overexpressed (Saijo et al. (2000) Plant J. 23: 319-327).

Exposure to dehydration invokes similar survival strategies in plants as does freezing stress (see, for example, Yelenosky (1989) Plant Physiol 89: 444-451) and drought stress induces freezing tolerance (see, for example, Siminovitch et al. (1982) Plant Physiol 69: 250-255; and Guy et al. (1992) Planta 188: 265-270). In addition to the induction of cold-acclimation proteins, strategies that allow plants to survive in low water conditions may include, for example, reduced surface area, or surface oil or wax production. In another example increased solute content of the plant prevents evaporation and water loss due to heat, drought, salinity, osmoticum, and the like therefore providing a better plant tolerance to the above stresses.

It will be appreciated that some pathways involved in resistance to one stress (as described above), will also be involved in resistance to other stresses, regulated by the same or homologous genes. Of course, the overall resistance pathways are related, not identical, and therefore not all genes controlling resistance to one stress will control resistance to the other stresses. Nonetheless, if a gene conditions resistance to one of these stresses, it would be apparent to one skilled in the art to test for resistance to these related stresses. Methods of assessing stress resistance are further provided hereinbelow and in the Examples section which follows.

The ability of the transgenic plants of some embodiments of the invention to endure stress is expected to affect plant biomass, vigor and yield. The opposite is also anticipated to present good results, essentially, improved biomass, vigor and/or yield is expected to improve the endurance of transgenic plants of the present invention to stress conditions.

Thus, as is further described in Examples 1-3 of the examples section which follows, transgenic plants according to some embodiments of the invention exhibit increased biomass (FIGS. 4A-C, 9 and 16), growth rate (FIGS. 5A-C, 6A-C), yield (FIG. 7) and chlorophyll content (FIG. 16) under abiotic stress conditions and/or non-stress (e.g., optimal) conditions. It should be noted that the increase in number of leaves per plant and/or seeds per plant can predict increase in oil content per plant.

Thus, according to an aspect of some embodiments of the invention, there is provided a method of increasing yield, biomass, vigor, growth rate of a plant, comprising expressing within the plant the nucleic acid construct of some embodiments of the invention, thereby increasing the yield, biomass, oil content, vigor, growth rate of the plant.

As used herein the phrase "plant biomass" refers to the amount (e.g., measured in grams of air-dry tissue) of a tissue produced from the plant in a growing season, which could also determine or affect the plant yield or the yield per growing area. An increase in plant biomass can be in the whole plant or in parts thereof such as aboveground (harvestable) parts, vegetative biomass, roots and seeds.

As used herein the phrase "growth rate" refers to the increase in plant organ/tissue size per time (can be measured in $cm^2$ per day).

As used herein the phrase "plant vigor" refers to the amount (measured by weight) of tissue produced by the plant in a given time. Hence increased vigor could determine or affect the plant yield or the yield per growing time or growing area. In addition, early vigor (seed and/or seedling) results in improved field stand. It should be noted that a plant yield can be determined under stress (e.g., abiotic stress, nitrogen-limiting conditions) and/or non-stress (normal) conditions.

Improving early vigor is an important objective of modern rice breeding programs in both temperate and tropical rice cultivars. Long roots are important for proper soil anchorage in water-seeded rice. Where rice is sown directly into flooded fields, and where plants must emerge rapidly through water, longer shoots are associated with vigour. Where drill-seeding is practiced, longer mesocotyls and coleoptiles are important for good seedling emergence. The ability to engineer early vigor into plants would be of great importance in agriculture. For example, poor early vigor has been a limitation to the introduction of maize (*Zea mays* L.) hybrids based on Corn Belt germplasm in the European Atlantic.

As used herein the phrase "plant yield" refers to the amount (as determined by weight or size) or quantity (numbers) of tissues or organs produced per plant or per growing season. Hence increased yield could affect the economic benefit one can obtain from the plant in a certain growing area and/or growing time. It should be noted that a plant yield can be affected by various parameters including, but not limited to, plant biomass; plant vigor; growth rate; seed yield; seed or grain quantity; seed or grain quality; oil yield; content of oil, starch and/or protein in harvested organs (e.g., seeds or vegetative parts of the plant); number of flowers (florets) per panicle (expressed as a ratio of number of filled seeds over number of primary panicles); harvest index; number of plants grown per area; number and size of harvested organs per plant and per area; number of plants per growing area (density); number of harvested organs in field; total leaf area; carbon assimilation and carbon partitioning (the distribution/allocation of carbon within the plant); resistance to shade; number of harvestable organs (e.g. seeds), seeds per pod, weight per seed; and modified architecture such as increase stalk diameter, thickness or improvement of physical properties (e.g. elasticity).

To analyze the effect of the transgene on plant physiology, one can assess overall yield and biomass, the tolerance of the plants to fertilizer deficiency and to abiotic stresses such as drought, salinity, cold and heat stresses, freezing, etc. Also of great importance is to assess whether the plant at any of its parts contains an increased content of protein, free amino acids, oil and any other metabolic compounds of value. As used herein the phrase "seed yield" refers to the number or weight of the seeds per plant, seeds per pod, or per growing area or to the weight of a single seed, or to the oil extracted per seed. Hence seed yield can be affected by seed dimensions (e.g., length, width, perimeter, area and/or volume), number of (filled) seeds and seed filling rate and by seed oil content. Hence increase seed yield per plant could affect the economic benefit one can obtain from the plant in a certain growing area and/or growing time; and increase seed yield per growing area could be achieved by increasing seed yield per plant, and/or by increasing number of plants grown on the same given area.

The term "seed" (also referred to as "grain" or "kernel") as used herein refers to a small embryonic plant enclosed in a covering called the seed coat (usually with some stored food), the product of the ripened ovule of gymnosperm and angiosperm plants which occurs after fertilization and some growth within the mother plant.

Seed yield is a particularly important trait, since the seeds of many plants are important for human and animal nutrition. Crops such as corn, rice, wheat, canola and soybean account for over half the total human caloric intake, whether through direct consumption of the seeds themselves or through consumption of meat products raised on processed seeds. They are also a source of sugars, oils and many kinds of metabolites used in industrial processes. Seeds contain an embryo (the source of new shoots and roots) and an endosperm (the source of nutrients for embryo growth during germination and during early growth of seedlings). The development of a seed involves many genes, and requires the transfer of metabolites from the roots, leaves and stems into the growing seed. The endosperm, in particular, assimilates the metabolic precursors of carbohydrates, oils and proteins and synthesizes them into storage macromolecules to fill out the grain.

The phrase "oil content" as used herein refers to the amount of lipids in a given plant organ, either the seeds (seed oil content) or the vegetative portion of the plant (vegetative oil content) and is typically expressed as percentage of dry weight (10% humidity of seeds) or wet weight (for vegetative portion). It should be noted that oil content is affected by intrinsic oil production of a tissue (e.g., seed, vegetative portion), as well as the mass or size of the oil-producing tissue per plant or per growth period. In one embodiment, increase in oil content of the plant can be achieved by increasing the size/mass of a plant's tissue(s) which comprise oil per growth period. Thus, increased oil content of a plant can be achieved by increasing the yield, growth rate, biomass and vigor of the plant.

As used herein, the phrase "non-stress conditions" refers to the growth conditions (e.g., water, temperature, light-dark cycles, humidity, salt concentration, fertilizer concentration in soil, nutrient supply such as nitrogen, phosphorous and/or potassium), that do not significantly go beyond the everyday climatic and other abiotic conditions that plants may encounter, and which allow optimal growth, metabolism, reproduction and/or viability of a plant at any stage in its life cycle (e.g., in a crop plant from seed to a mature plant and back to seed again). Persons skilled in the art are aware of normal soil conditions and climatic conditions for a given plant in a given geographic location. It should be noted that while the non-stress conditions may include some mild variations from the optimal conditions (which vary from one type/species of a plant to another), such variations do not cause the plant to cease growing without the capacity to resume growth.

Once expressed within the plant cell or the entire plant, the level of the polypeptide encoded by the exogenous polynucleotide can be determined by methods well known in the art such as, activity assays, Western blots using antibodies capable of specifically binding the polypeptide, Enzyme-Linked Immuno Sorbent Assay (ELISA), radio-immunoassays (RIA), immunohistochemistry, immunocytochemistry, immunofluorescence and the like.

Methods of determining the level in the plant of the RNA transcribed from the exogenous polynucleotide are well known in the art and include, for example, Northern blot analysis, reverse transcription polymerase chain reaction (RT-PCR) analysis (including quantitative, semi-quantitative or real-time RT-PCR) and RNA-m situ hybridization.

Plant lines exogenously expressing the polynucleotides of the invention are screened to identify those that show the greatest increase of the desired plant trait. The effect of the transgene (e.g., the nucleic acid construct encoding IPT under the stress-related promoter) on abiotic stress tolerance can be determined using known methods such as detailed below and in the Examples section which follows.

Abiotic Stress Tolerance—

Transformed (i.e., expressing the transgene) and non-transformed (wild type) plants are exposed to an abiotic stress condition, such as water deprivation, suboptimal temperature (low temperature, high temperature), nutrient deficiency, nutrient excess, a salt stress condition, osmotic stress, heavy metal toxicity, anaerobiosis, atmospheric pollution and UV irradiation.

Salinity Tolerance Assay—

Transgenic plants with tolerance to higher levels than the optimal salt concentrations for the wild type are expected to exhibit better germination, seedling vigor or growth in high salt as compared to wild type plants under the same salt concentration. Salt stress can be effected in many ways such as, for example, by irrigating the plants with a hyperosmotic solution, by cultivating the plants hydroponically in a hyperosmotic growth solution (e.g., Hoagland solution), or by culturing the plants in a hyperosmotic growth medium, e.g., 50% Murashige-Skoog medium (MS medium). Since different plants vary considerably in their tolerance to salinity, the salt concentration in the irrigation water, growth solution, or growth medium can be adjusted according to the specific characteristics of the specific plant cultivar or variety, so as to inflict a mild or moderate effect on the physiology and/or morphology of the plants (for guidelines as to appropriate concentration see, Bernstein and Kafkafi, Root Growth Under Salinity Stress In: Plant Roots, The Hidden Half 3rd ed. Waisel Y, Eshel A and Kafkafi U. (editors) Marcel Dekker Inc., New York, 2002, and reference therein). For example, a salinity tolerance test can be performed by irrigating plants at different developmental stages with increasing concentrations of sodium chloride (for example 50 mM, 100 mM, 200 mM, 400 mM NaCl) applied from the bottom and from above to ensure even dispersal of salt. Following exposure to the stress condition the plants are frequently monitored until substantial physiological and/or morphological effects appear in wild type plants. Thus, the external phenotypic appearance, degree of wilting and overall success to reach maturity and yield progeny are compared between control and transgenic plants. Quantitative parameters of tolerance measured include, but are not limited to, the average wet and dry weight, growth rate, leaf size, leaf coverage (overall leaf area), the weight of the seeds yielded, the average seed size and the number of seeds produced per plant. Transformed plants not exhibiting substantial physiological and/or morphological effects, or exhibiting higher biomass than wild-type plants, are identified as abiotic stress tolerant plants.

Osmotic Tolerance Test—

Osmotic stress assays (including sodium chloride and mannitol assays) are conducted to discriminate between general osmotic stress phenotype and sodium chloride-specific phenotype. Plants which are tolerant to osmotic stress may have more tolerance to drought and/or freezing. For salt and osmotic stress germination experiments, the medium is supplemented for example with 50 mM, 100 mM, 200 mM NaCl or 100 mM, 200 mM NaCl, 400 mM mannitol.

Drought Tolerance Assay/Osmoticum Assay—

Tolerance to drought is performed to identify the genes conferring better plant survival after acute water deprivation. To analyze whether the transgenic plants are more tolerant to drought, an osmotic stress produced by the non-ionic osmolyte sorbitol in the medium can be performed. Control and transgenic plants are germinated and grown in plant-agar plates for 4 days, after which they are transferred to plates containing 500 mM sorbitol. The treatment causes growth retardation, then both control and transgenic plants are compared, by measuring plant weight (wet and dry), yield, and by growth rates measured as time to flowering. Conversely, soil-based drought screens are performed with plants overexpressing the polynucleotides detailed above. Seeds from control *Arabidopsis* plants, or other transgenic plants overexpressing the polypeptide of the invention are germinated and transferred to pots. Drought stress is obtained after irrigation is ceased accompanied by placing the pots on absorbent paper to enhance the soil-drying rate. Transgenic and control plants are compared to each other when the majority of the control plants develop severe wilting. Plants are re-watered after obtaining a significant fraction of the control plants displaying a severe wilting. Plants are ranked comparing to controls for each of two criteria: tolerance to the drought conditions and recovery (survival) following re-watering.

Cold Stress Tolerance—

To analyze cold stress, mature (25 day old) plants are transferred to 4° C. chambers for 1 or 2 weeks, with constitutive light. Later on plants are moved back to greenhouse. Two weeks later damages from chilling period, resulting in growth retardation and other phenotypes, are compared between both control and transgenic plants, by measuring plant weight (wet and dry), and by comparing growth rates measured as time to flowering, plant size, yield, and the like. Heat stress tolerance—Heat stress tolerance is achieved by exposing the plants to temperatures above 34° C. for a certain period. Plant tolerance is examined after transferring the plants back to 22° C. for recovery and evaluation after 5 days relative to internal controls (non-transgenic plants) or plants not exposed to neither cold or heat stress.

Water Use Efficiency— can be determined as the biomass produced per unit transpiration. To analyze WUE, leaf relative water content can be measured in control and transgenic plants. Fresh weight (FW) is immediately recorded; then leaves are soaked for 8 hours in distilled water at room temperature in the dark, and the turgid weight (TW) is recorded. Total dry weight (DW) is recorded after drying the leaves at 60° C. to a constant weight. Relative water content (RWC) is calculated according to the following formula: RWC=(FW−DW)/(TW−DW)×100.

Fertilizer Use Efficiency—

To analyze whether the transgenic plants are more responsive to fertilizers, plants are grown in agar plates or pots with a limited amount of fertilizer, as described, for example, in Yanagisawa et al (Proc Natl Acad Sci USA. 2004. 101:7833-8). The plants are analyzed for their overall size, time to flowering, yield, protein content of shoot and/or grain. The parameters checked are the overall size of the mature plant, its wet and dry weight, the weight of the seeds yielded, the average seed size and the number of seeds produced per plant. Other parameters that may be tested are: the chlorophyll content of leaves (as nitrogen plant status and the degree of leaf verdure is highly correlated), amino acid and the total protein content of the seeds or other plant parts such as leaves or shoots, oil content, etc. Similarly, instead of providing nitrogen at limiting amounts, phosphate or potassium can be added at increasing concentrations. Again, the same parameters measured are the same as listed above. In this way, nitrogen use efficiency (NUE), phosphate use efficiency (PUE) and potassium use efficiency (KUE) are assessed, checking the ability of the transgenic plants to thrive under nutrient restraining conditions.

Nitrogen Use Efficiency—

To analyze whether the transgenic *Arabidopsis* plants are more responsive to nitrogen, plant are grown in 0.75-1.5 mM (nitrogen deficient conditions) or 6-10 mM (optimal nitrogen concentration). Plants are allowed to grow for additional 20 days or until seed production. The plants are then analyzed for their overall size, time to flowering, yield, protein content of shoot and/or grain/seed production. The parameters checked can be the overall size of the plant, wet and dry weight, the weight of the seeds yielded, the average seed size and the number of seeds produced per plant. Other parameters that may be tested are: the chlorophyll content of leaves (as nitrogen plant status and the degree of leaf greenness is highly correlated), amino acid and the total protein content of the seeds or other plant parts such as leaves or shoots and oil content. Transformed plants not exhibiting substantial physiological and/or morphological effects, or exhibiting higher measured parameters levels than wild-type plants, are identified as nitrogen use efficient plants.

Nitrogen Use Efficiency Assay Using Plantlets—

The assay is done according to Yanagisawa-S. et al. with minor modifications ("Metabolic engineering with Dofl transcription factor in plants. Improved nitrogen assimilation and growth under low-nitrogen conditions" Proc. Natl. Acad. ScL USA 101, 7833-7838). Briefly, transgenic plants which are grown for 7-10 days in 0.5×MS (Murashige-Skoog) supplemented with a selection agent are transferred to two nitrogen-limiting conditions: MS media in which the combined nitrogen concentration ($NH_4NO$ and $KNO_3$) was 0.2 mM or 0.05 mM. Plants are allowed to grow for additional 30-40 days and then photographed, individually removed from the Agar (the shoot without the roots) and immediately weighed (fresh weight) for later statistical analysis. Constructs for which only T1 seeds are available are sown on selective media and at least 25 seedlings (each one representing an independent transformation event) are carefully transferred to the nitrogen-limiting media. For constructs for which T2 seeds are available, different transformation events are analyzed. Usually, 25 randomly selected plants from each event are transferred to the nitrogen-limiting media allowed to grow for 3-4 additional weeks and individually weighed at the end of that period. Transgenic plants are compared to control plants grown in parallel under the same conditions. Mock-transgenic plants expressing the uidA reporter gene (GUS) under the same promoter are used as control.

Nitrogen Determination—

The procedure for N (nitrogen) concentration determination in the structural parts of the plants involves the potassium persulfate digestion method to convert organic N to NO (Purcell and King 1996 Argon. J. 88.111-113, the modified Cd mediated reduction of $NO_3$ to $NO_2$ (Vodovotz 1996 Biotechniques 20:390-394) and the measurement of nitrite by the Griess assay (Vodovotz 1996, supra). The absorbance values are measured at 550 nm against a standard curve of $NaNO_2$. The procedure is described in details in Samonte et al. 2006 Agron. J. 98:168-176.

Germination Tests—

Germination tests compare the percentage of seeds from transgenic plants that could complete the germination process to the percentage of seeds from control plants that are treated in the same manner. Normal conditions are considered for example, incubations at 22° C. under 22-hour light 2-hour dark daily cycles. Evaluation of germination and seedling vigor is conducted between 4 and 14 days after planting. The basal media is 50% MS medium (Murashige and Skoog, 1962 Plant Physiology 15, 473-497). Germination is checked also at unfavorable conditions such as cold (incubating at temperatures lower than 10° C. instead of 22° C.) or using seed inhibition solutions that contain high concentrations of an osmolyte such as sorbitol (at concentrations of 50 mM, 100 mM, 200 mM, 300 mM, 500 mM, and up to 1000 mM) or applying increasing concentrations of salt (of 50 mM, 100 mM, 200 mM, 300 mM, 500 mM NaCl). The effect of the transgene on plant's vigor, growth rate, biomass, yield and/or oil content can be determined using known methods. Plant vigor—The plant vigor can be calculated by the increase in growth parameters such as leaf area, fiber length, rosette diameter, plant fresh weight and the like per time.

Growth Rate—

The growth rate can be measured using digital analysis of growing plants. For example, images of plants growing in greenhouse on plot basis can be captured every 3 days and the rosette area can be calculated by digital analysis. Rosette area growth is calculated using the difference of rosette area between days of sampling divided by the difference in days between samples. Evaluation of growth rate can be done by measuring plant biomass produced, rosette area, leaf size or root length per time (can be measured in $cm^2$ per day of leaf area).

Relative growth rate area can be calculated using regression coefficient of area along time course (in units of 1/day).

Seed Yield—

Evaluation of the seed yield per plant can be done by measuring the amount (weight or size) or quantity (i.e., number) of dry seeds produced and harvested from 8-16 plants and divided by the number of plants. For example, the total seeds from 8-16 plants can be collected, weighted using e.g., an analytical balance and the total weight can be divided by the number of plants. Seed yield per growing area can be calculated in the same manner while taking into account the growing area given to a single plant. Increase seed yield per growing area could be achieved by increasing seed yield per plant, and/or by increasing number of plants capable of growing in a given area. In addition, seed yield can be determined via the weight of 1000 seeds. The weight of 1000 seeds can be determined as follows: seeds are scattered on a glass tray and a picture is taken. Each sample is weighted and then using the digital analysis, the number of seeds in each sample is calculated. The 1000 seeds weight is calculated as the number of seed in sample/sample weight×1000.

The Harvest Index can be calculated as the average seed yield per plant/average dry weight.

Grain Protein Concentration—

Grain protein content (g grain protein $m^{-2}$) is estimated as the product of the mass of grain N (g grain N $m^{-2}$) multiplied by the N/protein conversion ratio of k-5.13 (Mosse 1990, supra). The grain protein concentration is estimated as the ratio of grain protein content per unit mass of the grain (g grain protein $kg^{-1}$ grain).

Fiber Length—

Fiber length can be measured using fibrograph. The fibrograph system was used to compute length in terms of "Upper Half Mean" length. The upper half mean (UHM) is the average length of longer half of the fiber distribution. The fibrograph measures length in span lengths at a given percentage point (Hypertext Transfer Protocol://World Wide Web (dot) cottoninc (dot) com/Classificationof Cotton/?Pg=4#Length).

According to some embodiments of the invention, increased yield of corn may be manifested as one or more of the following: increase in the number of plants per growing area, increase in the number of ears per plant, increase in the number of rows per ear, number of kernels per ear row, kernel weight, thousand kernel weight (1000-weight), ear length/diameter, increase oil content per kernel and increase starch content per kernel.

As mentioned, the increase of plant yield can be determined by various parameters. For example, increased yield of rice may be manifested by an increase in one or more of the following: number of plants per growing area, number of panicles per plant, number of spikelets per panicle, number of flowers per panicle, increase in the seed filling rate, increase in thousand kernel weight (1000-weight), increase oil content per seed, increase starch content per seed, among others. An increase in yield may also result in modified architecture, or may occur because of modified architecture.

Similarly, increased yield of soybean may be manifested by an increase in one or more of the following: number of plants per growing area, number of pods per plant, number of seeds per pod, increase in the seed filling rate, increase in thousand seed weight (1000-weight), reduce pod shattering, increase oil content per seed, increase protein content per seed, among others. An increase in yield may also result in modified architecture, or may occur because of modified architecture.

Increased yield of canola may be manifested by an increase in one or more of the following: number of plants per growing area, number of pods per plant, number of seeds per pod, increase in the seed filling rate, increase in thousand seed weight (1000-weight), reduce pod shattering, increase oil content per seed, among others. An increase in yield may also result in modified architecture, or may occur because of modified architecture.

Increased yield of cotton may be manifested by an increase in one or more of the following: number of plants per growing area, number of bolls per plant, number of seeds per boll, increase in the seed filling rate, increase in thousand seed weight (1000-weight), increase oil content per seed, improve fiber length, fiber strength, among others. An increase in yield may also result in modified architecture, or may occur because of modified architecture.

Oil Content

The oil content of a plant can be determined by extraction of the oil from the seed or the vegetative portion of the plant. Briefly, lipids (oil) can be removed from the plant (e.g., seed) by grinding the plant tissue in the presence of specific solvents (e.g., hexane or petroleum ether) and extracting the oil in a continuous extractor. Indirect oil content analysis can be carried out using various known methods such as Nuclear Magnetic Resonance (NMR) Spectroscopy, which measures the resonance energy absorbed by hydrogen atoms in the liquid state of the sample [See for example, Conway T F. and Earle F R., 1963, Journal of the American Oil Chemists' Society; Springer Berlin/Heidelberg, ISSN: 0003-021X (Print) 1558-9331 (Online)]; the Near Infrared (NI) Spectroscopy, which utilizes the absorption of near infrared energy (1100-2500 nm) by the sample; and a method described in WO/2001/023884, which is based on extracting oil a solvent, evaporating the solvent in a gas stream which forms oil particles, and directing a light into the gas stream and oil particles which forms a detectable reflected light.

Thus, the present invention is of high agricultural value for promoting the yield of commercially desired crops (e.g., biomass of vegetative organ such as poplar wood, or reproductive organ such as number of seeds or seed biomass).

Any of the transgenic plants described hereinabove or parts thereof may be processed to produce a feed, meal, protein or oil preparation, such as for ruminant animals.

The transgenic plants described hereinabove, which exhibit an increased oil content can be used to produce plant oil (by extracting the oil from the plant).

The plant oil (including the seed oil and/or the vegetative portion oil) produced according to the method of the invention may be combined with a variety of other ingredients. The specific ingredients included in a product are determined according to the intended use. Exemplary products include animal feed, raw material for chemical modification, biodegradable plastic, blended food product, edible oil, biofuel, cooking oil, lubricant, biodiesel, snack food, cosmetics, and fermentation process raw material.

Exemplary products to be incorporated to the plant oil include animal feeds, human food products such as extruded snack foods, breads, as a food binding agent, aquaculture feeds, fermentable mixtures, food supplements, sport drinks, nutritional food bars, multi-vitamin supplements, diet drinks, and cereal foods.

According to some embodiments of the invention, the oil comprises a seed oil.

According to some embodiments of the invention, the oil comprises a vegetative portion oil.

As used herein the term "about" refers to ±10%.

The terms "comprises", "comprising", "includes", "including", "having" and their conjugates mean "including but not limited to".

The term "consisting of" means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

As used herein, the term "treating" includes abrogating, substantially inhibiting, slowing or reversing the progression of a condition, substantially ameliorating clinical or aesthetical symptoms of a condition or substantially preventing the appearance of clinical or aesthetical symptoms of a condition.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions illustrate some embodiments of the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., Eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

General Materials and Experimental Methods

Construct Preparation—

The Metallothionein promoter was extracted from *Arabidopsis* genomic DNA using PCR with specific primers for the sequence between the 3' UTR of the previous gene and the 5' UTR of the Metallothionein gene resulting in an 1169 bp long fragment: 5'-GACGATGTTTCTGTGATTGT-GATTTTC-3' (SEQ ID NO:669) and 5'-ATTTTTCTCGA-GAAAATTCAAATTGAAG-3' (SEQ ID NO:670). The promoter was cloned into pGEM plasmid (promega) using normal conditions. The promoter was then cut out and inserted into pBluescript plasmid (Stratagene) using SmaI+PstI, and then inserted in pJHA212K [Yoo, S. Y., Bomblies, K., Yoo, S. K., Yang, J. W., Choi, M. S., Lee, J. S., Weigel, D., Ahn, J. H. (2005). "The 35S promoter used in a selectable marker gene of a plant transformation vector affects the expression of the transgene." Planta 221: 523-530] containing the NOS 3' terminator, using BamHI+Acc65. Isolation of the IPT gene from pCambia SARK-IPT (Rivero et al. 2007) and addition of a BglII site was done using PCR with a hi proofreading enzyme—SAWADY Pow DNA Polymerase, with specific primers adding the restriction site on the 5'-gaagatctttctctaatataaaaatcag-3' (SEQ ID NO:671) and 5'-TCTGATCTGAACATGTTATCCAG-3' (SEQ ID NO:672). The product was cut with BglII and inserted to the pJHA212K-MT promoter-NOS3' plasmid between the promoter and terminator after cutting it with BglII+SmaI. The binary plasmid was transformed into *Agrobacterium tumefaciens* using electroporation.

Transformation into *Arabidopsis* plants—

Single colony of *A. tumefaciens* was grown in 5 ml LB containing antibiotics suitable for plasmid resistance at 30° C. over two nights. 1 ml of the starter was added to 0.5 liter of LB containing the same antibiotics, and grown over night at 30° C. until O.D. measurements showed O.D$_{600}$>2. The medium was divided into two 250 ml tubes that were centrifuged in Sorvall centrifuge at the velocity of 6000 rpm for 20 minutes. The bacterial pellet was re-suspended with 500 ml transformation medium. 200 µl silwet (Catalogue number L-77, Setre Chemical Company, Memphis, Tenn., USA) and 44 µl benzylaminopurine (from 0.5 mM stock) were added to the 500 ml transformation buffer.

*Arabidopsis* plants at the age of 4-6 weeks, with blossoms at the first developmental stages were used for transformation. The *Agrobacterium* re-suspension was placed into glass jars, the flowers of the *Arabidopsis* plants were placed in the medium. Each plant was transformed for 5 minutes, and was then placed horizontally in a tray. The trays were covered with plastic bags to preserve the humidity, and placed in the growth room. The next day, the plastic bags were removed and the plants were placed vertically. The seeds were collected after maturation.

Transformation into Tobacco Plants—

Single colony of *A. tumefaciens* was grown in 5 ml LB containing antibiotics suitable for plasmid resistance at 30° C. over two nights. 10 µl, 20 µl and 50 µl from the *A. tumefaciens* culture were transferred to 50 ml YEB (Yeast Extract Broth; consists of 1.5 gr Yeast extract, 4 gr Bacto Peptone, 20 gr Sucrose, 0.5 gr MgSO$_4$ in water for a 1000 ml solution) without antibiotics and were grown in a 250 ml Erlenmeyer overnight at 30° C. Leaves from 4-8 week old tobacco plants, grown on ½ MS (Murashige and skoog) were cut into 1 centimeter square pieces; their bottom side grooved with a scalpel and placed up-side down on PET medium [consists of: MSO (4.3 gr MS salt 30 gr sucrose, 0.5 MES salt, 10 gr agar), 0.5 mg/l 2-4-Dichloriphenoxyacetic acid, 0.25 mg/l Kinetin] at 25° C. The next day, a final concentration of 375 µM acetosyringone was added to 25 ml of the *A. tumefaciens* culture that arrived at O.D.$_{600}$=0.4-0.8, and poured to Petri dish. The leaf pieces were dipped in the *A. tumefaciens* culture for 1 minute, blot dry on filter paper and were returned to the PET medium for 48 hours.

The leaf pieces were further transferred to RS medium (consists of: MSO, 2 mg/l Zeatin, 0.1 mg/l IAA, 100 mg/l Kan, 200 mg/l carb) containing the appropriate antibiotics at 25° C. The pieces were transferred into new RS medium every two weeks until callus formation. Big calluses with small shoots were transferred to LZ medium (consists of: MSO, 0.2 mg/l Zeatin, 0.1 mg/l IAA, 100 mg/l Kan, 200 mg/l carb). The plantlets were subcultured every two weeks. Large plantlets with 3-5 leaves were transferred to selective rooting medium (medium consists of MSO medium+0.02 mg/l IBA 100 mg/l KAN 200 mg/l Carb) containing antibiotics. After root formation, the plants were transferred to water soaked peat pellets (Jiffy 7, Kappa Forenade Well).

Transformation into Tomato Plants—

10-14 days after seed germination, the apical tips of the tomato seedling were cut off and the cotyledons were excised and placed in D1 medium [D1 medium composition for preparation of 1 liter, pH 5.8: 4.3 g MS salt, 30 g sucrose, 5 ml B5 Vitamins, 6 g agar, 1 ml zeatin (1 mg/ml), 100 µl IAA (1 mg/ml), 500 mg Carbenicillin] without antibiotics and incubated for 24-48 hours in the dark at 26° C. For the transformation, *Agrobacterium* culture which includes the construct was poured over the cotyledons and incubated for two days at 26° C. at 16 hour light/8 hours dark, following which the cotyledons were transferred to D1 medium [D1 medium composition for preparation of 1 liter, pH 5.8: 4.3 g MS salt, 30 g sucrose, 5 ml B5 Vitamins, 6 g agar, 1 ml zeatin (1 mg/ml), 100 μl IAA (1 mg/ml), 500 mg Carbenicillin, 10 mg Kanamycin) and incubated for 3 weeks. The cotyledons were then transferred to Petri plates containing D2 medium for shoot organogenesis, and after another 3 weeks, the calluses that were formed, were transferred to a new D2 containing Petri dished. When shoots with true meristems arose, they were transferred to RO-D [rooting media; RO-D medium composition for 1 liter, pH 5.8: 4.3 g MS salt, 15 g sucrose, 5 ml B5 Vitamins, 6 g agar, 20 μl IBA (1 mg/ml), 500 mg Carbenicillin and 100 mg Kanamycin], and after root formation, the plants were transferred to water soaked peat pellets (Jiffy 7, Kappa Forenade Well).

Growth Conditions of Transgenic and Wild Type Plants—

Wild type (WT) and M-IPT transgenic tobacco plants (transgenic plants transformed to express the nucleic acid construct which comprises the metallothionein promoter fused to the IPT coding sequence) were grown with limited amount of water: 400, 200 and 100 ml. 400 ml water treatment is the optimal amount of water for plant growth in this experiment. Thus, the 200 and 100 ml watering treatments were 50% and 25% (respectively) of optimal watering conditions and simulated drought. Samples were taken from the plants every two weeks and RNA was extracted.

Example 1

Transgenic Plants Expressing IPT Under the Metallothionein Promoter Exhibit Increased Tolerance to Drought Stress and Increased Biomass In a large scale gene identification study the expression level of a metallothionein (a protein involved in plant resistance to metals) was found to increase during senescence of *Arabidopsis* plants (Gepstein, S., Sabehi, G., Carp, M. J., Hajouj, T., Falah, M., Nesher, O., Yariv, I., Dor, C. and Bassani, M. (2003). "Large scale identification of leaf senescence associated genes." The plant journal 36: 629-642).

In order to create plants with auto-regulated cytokinin level during stress, the metallothionein promoter of the MT2a type (At3g09390) was fused to the IPT gene and transformed to tobacco plants.

The chimeric construct which comprises the metallothionein promoter fused upstream of the IPT coding sequence and followed by the NOS terminator was prepared as described under "General Materials and Experimental Methods" and in FIGS. 1 and 2.

Experimental Results

Upregulation of M-IPT Expression Levels in Transgenic Plants Grown Under Drought Conditions—

The expression of IPT was examined in the transgenic plants under the different water regimes, and was found to be higher in the plants grown with limited amounts (100 and 200 ml) of water (FIG. 3). The expression seemed to increase as the plants grew older, but still remained highest in plants undergoing severe drought stress. These results indicate up-regulation of IPT expression level under drought stress. In addition, as shown in FIGS. 5A-C, the chlorophyll content of the stress-induced plants was higher than the plants grown with optimal watering, indicating cytokinin's (CK's) role in delaying senescence in these plants.

M-IPT Transgenic Plants Exhibit a Significantly Less Reduction in the Number of Leaves Per Plant Due to Drought Stress as Compared to Wild Type Plants—

After two months of growth, the fresh leaf biomass was analyzed, weighed and morphological parameters including for example, height and number of leaves of the plants, were measured. The height was equally affected by drought in WT and M-IPT transgenic plants. The 50% watering treatment resulted in 20-25% decrease in height, while the 25% watering treatment resulted in about 55% decrease in plant's height (FIG. 4A). Despite the similarity in the plants height, the number of leaves was reduced in WT plants in the 50% and 25% treatments, by 7% and 20%, respectively, as opposed to the transgenic plants that were not affected at the 50% treatment and were only slightly reduced by 6-12% in the 25% watering treatment (FIG. 4B).

M-IPT Transgenic Plants Exhibit a Significantly Less Reduction in Biomass Due to Drought Stress as Compared to Wild Type Plants—

In agreement with the reduction in the number of leaves, the biomass (as expressed by fresh weight) of WT plants was significantly reduced in drought conditions. In the treatment of 50% water supply, the biomass declined by 20% and in the 25% water supply, the biomass declined by 51%. Surprisingly, the biomass of the transgenic plants was not reduced, even under 50% less water (FIG. 4C). Furthermore, the fresh weight slightly increased in this treatment by 2-8% (FIG. 4C). On the other hand, the fresh weight of the 25% watering treatment was severely affected and a decrease of 45-49% (lines pM-IPT 7, 8 respectively) was observed in these plants (FIG. 4C). These results further suggest a high resistance to drought conferred by the enhanced level of IPT in the transgenic plants as compared to control plants (wild type plant) not transformed by the biomolecules of some embodiments of the invention when grown under the same conditions.

M-IPT Transgenic Plants Maintain Higher Chlorophyll Levels Under Drought Conditions as Compared to Wild Type Plants—

As shown in FIGS. 5A-C while following 4 months the wild type plants started to senesce in all three water regimes, as demonstrated by the reduction in chlorophyll content, the transgenic plants maintained a higher chlorophyll level especially in the plants that were watered with limited amounts.

The Root Size of M-IPT Transgenic Plants is not Affected by Water Regimes—

The plant's roots were extracted from the soil and cleaned from soil remnants as best as possible. The weight was not examined since the weight is still affected by the remained soil, but the differences in the root size are clearly seen. While in WT plants there is a clear gradation in the size of the roots and as the amount of watering increases, the root size increases respectively, in the transgenic plants the size of the roots in not correlated to the amount of watering, but rather is highest in the 200 ml treatment where the general biomass was also found to be highest (FIGS. 6A-C).

Seed Yield of M-IPT Transgenic Plants is Highest at 50% Water Regimes as Compared to Seed Yield of WT Plants which is Highest at 100% Water Regime—

The shoots and flowers were left to grow for another month (after biomass was collected) to allow the seeds to mature and dry out. The dried seeds were weighed and compared in the different water regimes (FIG. 7). The highest yield of WT plants was observed under the 400 ml treatment and was reduced by 15% and 60% respectively in the restricted water supply conditions (200 ml and 100 ml treatments, respectively). The highest yield of the transgenic plants was found in the 200 ml treatment with a 20% increase relative to the 400 ml treatment. The yield of the 100 ml treatment was also reduced but only by 30-40% (as oppose to 60% in the WT plants), in-spite of the fact that the biomass of the 100 ml treatment was reduced by 50% in both the transgenic and WT plants.

M-IPT Transgenic Plants Recover Well from Long Term Drought as Compared to Wild Type Plants—

The drought tolerance of pM-IPT tobacco was further examined in long-term drought. Watering of mature WT and pM-IPT plants was stopped for two weeks. Following this period, plants were re-watered for 1 week. pM-IPT plants recovered well from this stress, as opposed to only 30% recovery in the WT plants (FIGS. 8A-D). The leaf biomass of the plants was harvested one week after re-watering, weighed and compared to plants grown under optimal watering conditions. The biomass (as expressed by fresh weight) of WT plants that were exposed to drought stress was ~60% lower than the biomass of plants grown under optimal water regimes (FIG. 9). On the other hand in the pM-IPT plants, the biomass decreased by only 10%-30% (lines 8 and 7 respectfully) in the plants under drought stress (FIG. 9).

Example 2

Transgenic Plants Expressing IPT Under the Metallothionein Promoter Exhibit Increased Tolerance to Heat Stress, Cold Stress, High Salinity and Osmotic Stress Experimental Results To test the effect of the M-IPT transgene on additional abiotic stresses, three week old tobacco plants were subjected with the following stress treatments: high salinity, osmotic stress, heat and low temperature.

M-IPT Transgenic Plants Exhibit Increased Tolerance and Resistance to Heat Stress as Compared to Wild Type Plants—

Plants were treated with heat stress by growing the plants for 1 week at a temperature of 37° C., following by transferring the plants to room temperature conditions (24° C.) for recovery. The plants growth was severely affected by this stress and only 40% of the plants survived after one week of heat treatment. During the recovery of the remaining plants, there were noticeable differences between the plants: WT plants remained small and although they did not die, their growth was greatly reduced. However, the recovery of the transgenic plants was faster and they grew better than the WT plants (FIGS. 10A-D).

M-IPT Transgenic Plants Exhibit Increased Tolerance and Resistance to Cold Stress as Compared to Wild Type Plants—

Plants were subjected to low temperatures by growing the plants at 4° C. for 1 week and then were transferred to room temperature conditions (24° C.) for recovery. The growth of plants was delayed during the period at 4° C., but all plants made a full recovery when transferred back to 24° C., and their size was only slightly delayed compared to plants grown in normal conditions. Although the size of the M-IPT and WT plants was similar after one and two weeks of recovery, the M-IPT plant grew at a faster rate after three weeks of recovery and a significant difference can be seen especially after 4 weeks of recovery from the cold treatment (FIGS. 11A-D).

M-IPT Transgenic Plants Exhibit Increased Tolerance and Resistance to Salt Stress as Compared to Wild Type Plants—

Plants were subjected to high salinity by watering the plant with a 300 mM NaCl solution for 3 weeks, following which the plants were watered with tap water for recovery. The growth of all plants, under the salt treatment was reduced, although the transgenic plants grew better than the WT plants. The recovery of M-IPT plants from the salt stress was extremely fast, and the development and biomass of the transgenic plants was improved. In contrast, the WT grew much slower and did not seem to recover as well (FIGS. 12A-D).

M-IPT Transgenic Plants Exhibit Increased Tolerance and Resistance to Osmotic Stress as Compared to Wild Type Plants—

Plants were watered with a 20% PEG 6000 solution for 3 weeks, and were then watered with tap water for recovery. The PEG treatment was extremely severe on all plants. While WT plants did not grow at all during these 3 weeks the transgenic plants grew only slightly and showed extreme stress symptoms. After recovery none of the WT plants were able to survive. On the other hand, the M-IPT plants did survive but yet did not display full recovery after two weeks of regular watering (FIGS. 13A-C).

The behavior of the plants in the four abiotic stresses examined was different throughout the stress and the recovery. In spite of these differences, after recovery, plants of all four stresses showed significant differences in the plant growth between the transgenic M-IPT plants and WT plants (FIGS. 14A-C), suggesting the M-IPT plants exhibit enhanced tolerance to different stress conditions.

Analysis and Discussion

As often found in nature, a combination of abiotic stresses affects plants, and numerous stresses act simultaneously (Mittler, 2006). In desert regions, plants often encounter drought stress that is accompanied with salinity stress, high temperature during the day and low temperatures in the night. For this reason plants that exhibit resistance against multi-abiotic stresses are advantageous.

The M-IPT transgenic plants described herein exhibit enhanced tolerance and resistance to a number of different stress conditions and are therefore useful for multiple agricultural uses.

Example 3

Transgenic Plants Over-Expressing IPT Under a Stress Related Promoter Exhibit Increased Yield and Chlorophyll Content As shown in FIG. 16 the M-IPT7 and M-IPT8 transgenic plants have 20% higher yield than the WT plants when grown under optimal conditions and 50% higher yield in drought. The senescence is also delayed in the transgenic plant when grown under optimal conditions and therefore the chlorophyll content is higher in mature plants.

Example 4

Core Sequences Observed in Promoter Regions of Genes Upregulated Under Various Stresses The present inventors have identified core sequences of stress-related regulatory sequences present in promoters of genes which are upregulated under various stresses such as drought, cold and high-salinity stresses.

ABRE (ABA response element)—PyACGTG(T/G)C (SEQ ID NO:2). Examples include, but are not limited to TACGTGTC (SEQ ID NO:3), CACGTGGC (SEQ ID NO:4).

DRE (dehydration response element)—TACCGACAT (SEQ ID NO:5).

CCGAC Core Motif—CCGAC (SEQ ID NO:6).

Table 1, below, provides non-limiting examples of conserved cis elements which are present in stress-related promoters are provided in Table 1, below.

Vol. 130, pp. 2129-2141; Rossel et al. (2002), Global Changes in Gene Expression in Response to High Light in *Arabidopsis*, Plant Physiol, November 2002, Vol. 130, pp. 1109-1120; Vogel et al. (2005), Roles of the CBF2 and ZAT12 transcription factors in configuring the low temperature transcriptome of *Arabidopsis*, Plant J. 2005 January; 41(2):195-211; Matsui et al. (2008), *Arabidopsis* Transcriptome Analysis under Drought, Cold, High-Salinity and ABA Treatment Conditions using a Tiling Array, Plant and Cell Physiology 2008 49(8):1135-1149; Seki et al. (2001), Monitoring the Expression Pattern of 1300 *Arabidopsis* Genes under Drought and Cold Stresses by Using a Full-Length

TABLE 1 cis-Acting regulatory elements in osmotic- and cold-stress-responsive gene expression

| Cis element | Sequence | SEQ ID NO: | Type of transcription factors that bind to the cis element | Gene Symbol of the gene including the cis element | SEQ ID NO: | Stress condition |
|---|---|---|---|---|---|---|
| ABRE | PyACGTGGC | 7 | bZIP | Em, RAB16 | | Water deficit, ABA |
| CE1 | TGCCACCGG | 8 | ERF/AP2 | HVA1 | | ABA |
| CE3 | ACGCGTGCCTC | 9 | Not known | HVA22 | | ABA |
| ABRE | ACGTGTC | 10 | bZIP | Osem | | ABA |
| ABRE | ACGTGGC (SEQ ID NO: 14) ACGTGTC (SEQ ID NO: 11) | 14, 11 | bZIP | RD29B | | Water deficit, ABA |
| MYBR | TGGTTAG | 12 | MYB | RD22 | | Water deficit, ABA |
| MYCR | CACATG | 13 | bHLH | RD22 | | Water deficit, ABA |
| DRE | TACCGACAT | 5 | ERF/AP2 | RD29A | | Water deficit, cold |
| CRT | GGCCGACAT | 15 | ERF/AP2 | Cor15A | | Cold |
| LTRE | GGCCGACGT | 16 | ERF/AP2 | BN115 | | Cold |
| NACR | ACACGCATGT | 17 | NAC | ERD1 | | Water deficit |
| ZFHDR | Not yet reported | | ZFHD | ERD1 | | Water deficit |
| ICEr1 | GGACACATGTCAGA | 18 | Not known | CBF2/DRE B1C | | Cold |
| ICEr2 | ACTCCG | 19 | Not known | CBF2/DRE B1C | | Cold |

Example 5

Stress-Related Promoters

Identification of stress related promoter sequences was performed using known bioinformatics tools. Genes which are known to be expressed under various stresses were found using the following references: Sottosanto et al. (2004), DNA array analyses of *Arabidopsis thaliana* lacking a vacuolar Na+/H+ antiporter: impact of AtNHX1 on gene expression, Plant Journal 40, 752-771); Kreps et al. (2002), Transcriptome Changes for *Arabidopsis* in Response to Salt, Osmotic, and Cold Stress. Plant Physiol, December 2002, cDNA Microarray, Plant Cell. 2001 January; 13(1):61-72; Seki et al. (2002), Monitoring the expression profiles of 7000 *Arabidopsis* genes under drought, cold and high-salinity stresses using a full-length cDNA microarray, Plant J. 2002 August; 31(3):279-92; and Yamaguchi-Shinozaki and Shinozaki (2005), Organization of cis-acting regulatory elements in osmotic- and cold-stress-responsive promoters, Trends in Plant Science 10, 88-94.

The regulatory sequences of these genes were identified as described using the AGRIS (*Arabidopsis* Gene Regulatory Information Server) which contains two databases, AtTFDB (*Arabidopsis thaliana* transcription factor database) and AtcisDB (*Arabidopsis thaliana* cis-regulatory database) and is described in Davuluri R V., Sun H., et al., 2003 [AGRIS: *Arabidopsis* Gene Regulatory Information Server, an information resource of *Arabidopsis* cis-regulatory elements and transcription factors] which is fully incorporated herein by reference. The AGRIS database includes sequences which are located upstream of the translation start site (ATG) of the annotated coding sequences. The upstream sequences include 3000 nucleotides or less. Briefly, the fasta file 'TAIR9_upstream_3000_translation_start_20090619' was downloaded from the *Arabidopsis* Information Resource (TAIR) database [Hypertext Transfer Protocol:// World Wide Web (dot) arabidopsis (dot) org] and relevant sequences extracted according to the gene list produced above using R environment ("R Development Core Team (2010). R: A language and environment for statistical computing. R Foundation for Statistical Computing, Vienna, Austria. ISBN 3-900051-07-0, Hypertext Transfer Protocol://World Wide Web (dot) R-project (dot) org").

Table 2, below, provides a non-limiting list of genes of *Arabidopsis Thaliana* which are upregulated during various stresses (salt stress, cold stress and drought stress), along with the promoter sequences of the indicated stress related genes.

TABLE 2

Salt, cold and drought related promoters

| Salt stress gene | Salt stress-related promoter SEQ ID NO: | Cold stress gene | Cold stress-related promoters SEQ ID NO: | Drought stress gene | Drought stress-related promoters SEQ ID NO: |
|---|---|---|---|---|---|
|  |  | Metabolism |  | Transcription factor |  |
| At1g74810 | 20 | At1g62570 | 267 | AT1G06180.1 | 55 |
| At3g12520 | 21 | At3g55610 | 268 | AT1G18710.1 | 454 |
| At3g59030 | 22 | At4g29510 | 269 | AT1G22640.1 | 56 |
| At1g08230 | 23 | At5g15950 | 270 | AT1G74080.1 | 58 |
| At2g47800 | 24 | At1g09350 | 237 | AT2G16720.1 | 59 |
| At3g53210 | 25 | At2g22190 | 271 | AT2G47190.1 | 60 |
| At1g66760 | 26 | At2g47180 | 272 | AT3G06490.1 | 61 |
| At2g16660 | 27 | At3g17130 | 273 | AT3G09370.1 | 62 |
| At1g68570 | 28 | At4g17090 | 274 | AT3G23250.1 | 63 |
| At5g02270 | 29 | At4g23920 | 275 | AT3G47600.1 | 65 |
| At5g65990 | 30 | At4g31140 | 276 | AT4G05100.1 | 68 |
| At5g14610 | 31 | At4g39800 | 277 | AT4G21440.1 | 69 |
| At2g07734 | 32 | At5g11110 | 278 | AT4G28110.1 | 405 |
| At5g09500 | 33 | At5g20830 | 279 | AT4G34990.1 | 70 |
| At2g27760 | 34 | At5g40390 | 280 | AT5G02320.1 | 73 |
| At2g40100 | 35 | At2g19450 | 281 | AT5G04760.1 | 74 |
| At1g23020 | 36 | At2g24560 | 282 | AT5G06100.1 | 75 |
| At1g50950 | 37 | At4g15130 | 283 | AT5G17300.1 | 77 |
| At4g11600 | 38 | At4g34650 | 284 | AT5G27610.1 | 455 |
| At3g03180 | 39 | At3g12670 | 285 | AT5G37260.1 | 78 |
| At2g23000 | 40 | At4g34740 | 286 | AT5G52660.1 | 456 |
| At5g65930 | 41 | At1g01420 | 287 | AT5G54230.1 | 457 |
| At5g65370 | 42 | At1g09240 | 288 | AT5G62470.1 | 458 |
| At4g04670 | 43 | At2g16890 | 289 | AT5G67300.1 | 459 |
| At2g24640 | 44 | At3g14440 | 290 | AT1G12610.1 | 79 |
| At3g55150 | 45 | At3g14690 | 291 | AT1G22190.1 | 80 |
| At4g33090 | 46 | At3g53260 | 292 | AT1G22810.1 | 81 |
| At5g59320 | 47 | At4g11280 | 293 | AT1G43160.1 | 82 |
| At5g09530 | 48 | At4g27570 | 294 | AT1G53910.1 | 83 |
| At4g16590 | 49 | At4g37320 | 295 | AT1G63030.1 | 84 |
| At1g02205 | 50 | At5g17030 | 296 | AT1G64380.1 | 85 |
| At3g23670 | 51 | At5g45340 | 297 | AT1G71520.1 | 86 |
| At1g26770 | 52 |  | Transcription | AT1G74930.1 | 87 |
| At1g15570 | 53 | At3g44750 | 298 | AT1G78080.1 | 89 |
| At1g48750 | 54 | At1g13260 | 299 | AT1G79700.1 | 90 |
|  | Transcription factor | At1g14580 | 300 | AT2G20880.1 | 91 |
| AT1G06180.1 | 55 | At1g21910 | 301 | AT2G38340.1 | 92 |
| AT1G22640.1 | 56 | At1g26790 | 302 | AT2G40340.1 | 93 |
| AT1G72650.1 | 57 | At1g27730 | 303 | AT3G11020.1 | 95 |
| AT1G74080.1 | 58 | At1g46768 | 304 | AT3G15210.1 | 96 |
| AT2G16720.1 | 59 | At1g49720 | 305 | AT3G50260.1 | 97 |
| AT2G47190.1 | 60 | At1g69570 | 306 | AT3G57600.1 | 98 |
| AT3G06490.1 | 61 | At1g76580 | 307 | AT3G61630.1 | 99 |
| AT3G09370.1 | 62 | At1g80840 | 308 | AT4G25470.1 | 322 |
| AT3G23250.1 | 63 | At2g21320 | 309 | AT4G25490.1 | 410 |
| AT3G30210.1 | 64 | At2g24500 | 310 | AT4G28140.1 | 460 |
| AT3G47600.1 | 65 | At2g38470 | 311 | AT4G34410.1 | 461 |
| AT3G50060.1 | 66 | At2g40140 | 312 | AT5G05410.1 | 462 |
| AT4G01280.1 | 67 | At2g45660 | 313 | AT5G51990.1 | 463 |
| AT4G05100.1 | 68 | At2g46830 | 314 | AT5G64750.1 | 413 |
| AT4G21440.1 | 69 | At2g47890 | 315 | AT1G09530.1 | 102 |
| AT4G34990.1 | 70 | At3g48100 | 316 | AT1G32640.1 | 103 |
| AT4G37260.1 | 71 | At3g55580 | 317 | AT1G51140.1 | 104 |
| AT5G01200.1 | 72 | At3g55980 | 318 | AT2G46510.1 | 110 |
| AT5G02320.1 | 73 | At4g01250 | 319 | AT3G22100.1 | 112 |
| AT5G04760.1 | 74 | At4g17490 | 320 | AT5G43650.1 | 117 |
| AT5G06100.1 | 75 | At4g18390 | 321 | Protein kinase |  |

TABLE 2-continued

Salt, cold and drought related promoters

| Salt stress gene | Salt stress-related promoter SEQ ID NO: | Cold stress gene | Cold stress-related promoters SEQ ID NO: | Drought stress gene | Drought stress-related promoters SEQ ID NO: |
|---|---|---|---|---|---|
| AT5G08520.1 | 76 | At4g25470 | 322 | AT1G48210.1 | 118 |
| AT5G17300.1 | 77 | At4g25480 | 323 | AT3G59350.1 | 120 |
| AT5G37260.1 | 78 | At4g29190 | 324 | AT1G07870.1 | 121 |
| AT1G12610.1 | 79 | At4g31800 | 325 | AT1G69790.1 | 122 |
| AT1G22190.1 | 80 | At4g32280 | 326 | AT3G09830.1 | 125 |
| AT1G22810.1 | 81 | At4g34990 | 70 | AT1G16130.1 | 131 |
| AT1G43160.1 | 82 | At4g37260 | 71 | AT1G79680.1 | 133 |
| AT1G53910.1 | 83 | At5g04340 | 327 | AT2G23450.1 | 134 |
| AT1G63030.1 | 84 | At5g16040 | 328 | AT5G66790.1 | 135 |
| AT1G64380.1 | 85 | At5g24470 | 329 | AT4G21390.1 | 140 |
| AT1G71520.1 | 86 | At5g47230 | 330 | AT4G23190.1 | 142 |
| AT1G74930.1 | 87 | At5g48250 | 331 | AT4G23220.1 | 143 |
| AT1G75490.1 | 88 | At5g51190 | 332 | AT2G19190.1 | 144 |
| AT1G78080.1 | 89 | At5g54470 | 333 | AT4G32300.1 | 147 |
| AT1G79700.1 | 90 | At5g57660 | 334 | AT5G24080.1 | 464 |
| AT2G20880.1 | 91 | At5g61600 | 335 | AT3G53810.1 | 148 |
| AT2G38340.1 | 92 | RNA processing and translation | | AT3G59700.1 | 149 |
| AT2G40340.1 | 93 | At2g03820 | 336 | AT4G02410.1 | 465 |
| AT2G46310.1 | 94 | At3g18600 | 337 | AT4G04960.1 | 150 |
| AT3G11020.1 | 95 | At4g16630 | 338 | AT5G01540.1 | 466 |
| AT3G15210.1 | 96 | At4g25630 | 339 | AT5G01550.1 | 151 |
| AT3G50260.1 | 97 | At4g34910 | 340 | AT5G65600.1 | 467 |
| AT3G57600.1 | 98 | At5g27120 | 341 | AT1G69270.1 | 155 |
| AT3G61630.1 | 99 | At3g44260 | 342 | AT2G13790.1 | 156 |
| AT1G02340.1 | 100 | At4g25500 | 188 | RNA binding protein | |
| AT1G06150.1 | 101 | At5g54910 | 343 | AT1G13190.1 | 160 |
| AT1G09530.1 | 102 | At1g56110 | 344 | AT1G20880.1 | 161 |
| AT1G32640.1 | 103 | At2g24050 | 345 | AT1G29400.1 | 163 |
| AT1G51140.1 | 104 | At3g55620 | 346 | AT1G58470.1 | 166 |
| AT1G59640.1 | 105 | At5g15750 | 347 | AT1G65660.1 | 168 |
| AT1G68920.1 | 106 | At5g20160 | 348 | AT1G69250.1 | 428 |
| AT2G31210.1 | 107 | At5g47880 | 215 | AT1G77680.1 | 170 |
| AT2G31280.1 | 108 | At5g59240 | 349 | AT2G42890.1 | 172 |
| AT2G43010.1 | 109 | Intercellular communication and signal transduction | | AT2G44710.1 | 175 |
| AT2G46510.1 | 110 | At1g73480 | 350 | AT3G12640.1 | 178 |
| AT3G19860.1 | 111 | At5g25110 | 351 | AT3G13224.1 | 179 |
| AT3G22100.1 | 112 | At1g66400 | 352 | AT3G20250.1 | 181 |
| AT3G62090.1 | 113 | At1g73630 | 353 | AT3G49130.1 | 184 |
| AT4G29930.1 | 114 | At2g46790 | 354 | AT4G03430.1 | 186 |
| AT4G37850.1 | 115 | At3g59350 | 120 | AT4G36960.1 | 189 |
| AT5G38860.1 | 116 | At3g59820 | 355 | AT5G07290.1 | 191 |
| AT5G43650.1 | 117 | At4g27280 | 356 | AT5G55100.1 | 200 |
| Protein kinase | | At5g27930 | 357 | AT5G61960.1 | 201 |
| AT1G48210.1 | 118 | At5g54490 | 358 | Transporter | |
| AT3G17410.1 | 119 | At5g58700 | 359 | AT5G14570.1 | 202 |
| AT3G59350.1 | 120 | At5g52820 | 360 | AT5G17850.1 | 203 |
| AT1G07870.1 | 121 | Energy | | AT5G18840.1 | 468 |
| AT1G69790.1 | 122 | At1g77120 | 361 | AT5G19410.1 | 469 |
| AT2G07180.1 | 123 | At4g33070 | 362 | AT5G26340.1 | 205 |
| AT2G39660.1 | 124 | At2g22500 | 363 | AT5G37500.1 | 437 |
| AT3G09830.1 | 125 | At4g05020 | 364 | AT5G41800.1 | 206 |
| AT3G55450.1 | 126 | At4g24570 | 365 | AT5G51710.1 | 470 |
| AT4G35600.1 | 127 | Transport | | AT5G60790.1 | 208 |
| AT5G02800.1 | 128 | At5g57110 | 366 | AT5G65990.1 | 30 |
| AT1G06840.1 | 129 | At5g14940 | 367 | Protease | |
| AT1G16110.1 | 130 | At1g08920 | 368 | AT1G32940.1 | 209 |
| AT1G16130.1 | 131 | At4g17550 | 369 | AT4G21320.1 | 211 |
| AT1G16150.1 | 132 | At4g35300 | 370 | AT5G67090.1 | 471 |
| AT1G79680.1 | 133 | At1g51610 | 371 | Protein synthesis | |
| AT2G23450.1 | 134 | At1g69870 | 372 | AT1G29970.1 | 212 |
| AT5G66790.1 | 135 | At1g75370 | 373 | AT2G44070.1 | 213 |
| AT1G61420.1 | 136 | At2g16990 | 374 | AT3G22980.1 | 214 |
| AT1G61460.1 | 137 | At2g28900 | 375 | AT5G47880.1 | 215 |
| AT3G16030.1 | 138 | Stress related | | Plant defense | |
| AT4G04490.1 | 139 | At2g17840 | 376 | AT1G14540.1 | 441 |
| AT4G21390.1 | 140 | At1g20030 | 377 | AT2G02100.1 | 218 |
| AT4G23180.1 | 141 | At1g72940 | 378 | AT2G02120.1 | 380 |
| AT4G23190.1 | 142 | At1g75040 | 379 | AT2G22420.1 | 219 |
| AT4G23220.1 | 143 | At2g02100 | 218 | AT3G49120.1 | 472 |
| AT2G19190.1 | 144 | At2g02120 | 380 | AT4G31760.1 | 220 |
| AT5G39030.1 | 145 | At2g35960 | 381 | AT5G05340.1 | 473 |
| AT1G34300.1 | 146 | At2g43620 | 382 | Energy | |
| AT4G32300.1 | 147 | At5g06860 | 383 | AT1G07810.1 | 474 |

TABLE 2-continued

Salt, cold and drought related promoters

| Salt stress gene | Salt stress-related promoter SEQ ID NO: | Cold stress gene | Cold stress-related promoters SEQ ID NO: | Drought stress gene | Drought stress-related promoters SEQ ID NO: |
|---|---|---|---|---|---|
| AT3G53810.1 | 148 | At3g05660 | 384 | AT1G59820.1 | 475 |
| AT3G59700.1 | 149 | At1g01470 | 385 | AT1G63440.1 | 476 |
| AT4G04960.1 | 150 | At1g20440 | 386 | AT1G72700.1 | 443 |
| AT5G01550.1 | 151 | At1g20450 | 387 | AT2G24520.1 | 223 |
| AT5G60270.1 | 152 | At1g30360 | 388 | AT3G27870.1 | 477 |
| AT5G60280.1 | 153 | At2g42530 | 389 | AT4G00900.1 | 224 |
| AT5G48380.1 | 154 | At2g42540 | 390 | Metabolism | |
| AT1G69270.1 | 155 | At3g50970 | 391 | AT1G01120.1 | 478 |
| AT2G13790.1 | 156 | At4g02380 | 392 | AT1G01480.1 | 225 |
| AT3G02130.1 | 157 | At5g15960 | 393 | AT1G02400.1 | 227 |
| RNA binding protein | | At5g52310 | 394 | AT1G02660.1 | 228 |
| AT1G07350.1 | 158 | At3g22840 | 395 | AT1G03090.1 | 229 |
| AT1G09230.1 | 159 | At4g14690 | 396 | AT1G04220.1 | 479 |
| AT1G13190.1 | 160 | At4g36010 | 397 | AT1G05560.1 | 230 |
| AT1G20880.1 | 161 | At1g11210 | 398 | AT1G05680.1 | 231 |
| AT1G27650.1 | 162 | At1g16850 | 399 | AT1G05790.1 | 232 |
| AT1G29400.1 | 163 | At1g29395 | 400 | AT1G06570.1 | 233 |
| AT1G50300.1 | 164 | At1g67360 | 401 | AT1G07720.1 | 480 |
| AT1G55310.1 | 165 | At1g80130 | 402 | AT1G08630.1 | 234 |
| AT1G58470.1 | 166 | At2g15970 | 403 | AT1G09350.1 | 237 |
| AT1G60650.1 | 167 | Transcription factor | | AT1G09490.1 | 238 |
| AT1G65660.1 | 168 | AT1G74840.1 | 404 | AT1G09500.1 | 239 |
| AT1G71720.1 | 169 | AT2G46830.1 | 314 | AT1G09940.1 | 240 |
| AT1G77680.1 | 170 | AT4G28110.1 | 405 | AT1G15380.1 | 244 |
| AT2G21660.1 | 171 | AT5G17300.1 | 77 | AT1G16540.1 | 245 |
| AT2G42890.1 | 172 | AT5G37260.1 | 78 | AT1G17420.1 | 246 |
| AT2G43370.1 | 173 | AT1G21910.1 | 301 | AT1G17745.1 | 481 |
| AT2G43410.1 | 174 | AT1G43160.1 | 82 | AT1G22400.1 | 248 |
| AT2G44710.1 | 175 | AT1G53910.1 | 83 | AT1G23870.1 | 249 |
| AT2G46610.1 | 176 | AT1G72360.1 | 406 | AT1G26380.1 | 448 |
| AT3G01150.1 | 177 | AT1G77640.1 | 407 | AT1G27980.1 | 482 |
| AT3G12640.1 | 178 | AT1G79700.1 | 90 | AT1G30040.1 | 483 |
| AT3G13224.1 | 179 | AT2G28550.1 | 408 | AT1G30620.1 | 449 |
| AT3G13740.1 | 180 | AT2G40340.1 | 93 | AT1G30820.1 | 450 |
| AT3G20250.1 | 181 | AT3G11020.1 | 95 | AT1G34630.1 | 250 |
| AT3G27700.1 | 182 | AT3G15210.1 | 96 | AT1G51760.1 | 253 |
| AT3G45630.1 | 183 | AT3G50260.1 | 97 | AT1G53580.1 | 254 |
| AT3G49130.1 | 184 | AT3G54990.1 | 409 | AT1G56600.1 | 255 |
| AT3G52660.1 | 185 | AT4G25470.1 | 322 | AT1G60140.1 | 451 |
| AT4G03430.1 | 186 | AT4G25480.1 | 323 | AT1G60470.1 | 452 |
| AT4G10610.1 | 187 | AT4G25490.1 | 410 | AT1G63180.1 | 484 |
| AT4G25500.1 | 188 | AT4G36920.1 | 411 | AT1G64660.1 | 485 |
| AT4G36960.1 | 189 | AT5G52020.1 | 412 | AT1G67070.1 | 257 |
| AT4G37120.1 | 190 | AT5G64750.1 | 413 | AT1G67980.1 | 258 |
| AT5G07290.1 | 191 | AT1G02340.1 | 100 | AT1G68020.1 | 259 |
| AT5G15390.1 | 192 | AT1G18400.1 | 414 | AT1G70290.1 | 260 |
| AT5G16260.1 | 193 | AT1G72210.1 | 415 | AT1G71100.1 | 486 |
| AT5G18110.1 | 194 | AT2G46970.1 | 416 | AT1G71697.1 | 261 |
| AT5G19960.1 | 195 | AT3G05800.1 | 417 | AT1G72520.1 | 263 |
| AT5G23080.1 | 196 | AT5G51790.1 | 418 | AT1G72680.1 | 264 |
| AT5G51120.1 | 197 | Protein kinase | | AT1G73370.1 | 487 |
| AT5G51410.1 | 198 | AT1G48210.1 | 118 | AT1G73880.1 | 265 |
| AT5G53180.1 | 199 | AT3G59350.1 | 120 | AT1G73920.1 | 266 |
| AT5G55100.1 | 200 | AT1G07570.1 | 419 | | |
| AT5G61960.1 | 201 | AT2G28930.1 | 420 | | |
| Transporter | | AT3G55450.1 | 126 | | |
| AT5G14570.1 | 202 | AT5G35580.1 | 421 | | |
| AT5G17850.1 | 203 | AT5G66790.1 | 135 | | |
| AT5G17860.1 | 204 | AT1G52290.1 | 422 | | |
| AT5G26340.1 | 205 | AT1G53430.1 | 423 | | |
| AT5G41800.1 | 206 | AT1G53440.1 | 424 | | |
| AT5G46050.1 | 207 | AT1G61380.1 | 425 | | |
| AT5G60790.1 | 208 | AT1G51800.1 | 426 | | |
| Protease | | AT1G51820.1 | 427 | | |
| AT1G32940.1 | 209 | AT2G19190.1 | 144 | | |
| AT1G32950.1 | 210 | AT4G32300.1 | 147 | | |
| AT4G21320.1 | 211 | AT3G53810.1 | 148 | | |
| Protein synthesis | | RNA binding protein | | | |
| AT1G29970.1 | 212 | AT1G69250.1 | 428 | | |
| AT2G44070.1 | 213 | AT1G78260.1 | 429 | | |
| AT3G22980.1 | 214 | AT2G21660.1 | 171 | | |
| AT5G47880.1 | 215 | AT3G52660.1 | 185 | | |
| AT5G54940.1 | 216 | AT4G25500.1 | 188 | | |
| Plant defense | | Transporter | | | |

TABLE 2-continued

Salt, cold and drought related promoters

| Salt stress gene | Salt stress-related promoter SEQ ID NO: | Cold stress gene | Cold stress-related promoters SEQ ID NO: | Drought stress gene | Drought stress-related promoters SEQ ID NO: |
|---|---|---|---|---|---|
| AT1G19610.1 | 217 | AT3G62150.1 | 430 | | |
| AT2G02100.1 | 218 | AT4G05120.1 | 431 | | |
| AT2G22420.1 | 219 | AT4G17550.1 | 369 | | |
| AT4G31760.1 | 220 | AT4G18210.1 | 432 | | |
| AT5G39580.1 | 221 | AT4G21680.1 | 433 | | |
| Energy | | AT4G23700.1 | 434 | | |
| AT1G64200.1 | 222 | AT4G35180.1 | 435 | | |
| AT2G24520.1 | 223 | AT5G01180.1 | 436 | | |
| AT4G00900.1 | 224 | AT5G14570.1 | 202 | | |
| Metabolism | | AT5G17850.1 | 203 | | |
| AT1G01480.1 | 225 | AT5G26340.1 | 205 | | |
| AT1G01710.1 | 226 | AT5G37500.1 | 437 | | |
| AT1G02400.1 | 227 | AT5G41610.1 | 438 | | |
| AT1G02660.1 | 228 | AT5G46050.1 | 207 | | |
| AT1G03090.1 | 229 | AT5G48410.1 | 439 | | |
| AT1G05560.1 | 230 | Protease | | | |
| AT1G05680.1 | 231 | AT5G44530.1 | 440 | | |
| AT1G05790.1 | 232 | | | | |
| AT1G06570.1 | 233 | Protein synthesis | | | |
| AT1G08630.1 | 234 | AT5G47880.1 | 215 | | |
| AT1G08830.1 | 235 | Plant defense | | | |
| AT1G08980.1 | 236 | AT1G14540.1 | 441 | | |
| AT1G09350.1 | 237 | AT1G68850.1 | 442 | | |
| AT1G09490.1 | 238 | AT2G02100.1 | 218 | | |
| AT1G09500.1 | 239 | AT2G02120.1 | 380 | | |
| AT1G09940.1 | 240 | AT5G39580.1 | 221 | | |
| AT1G12240.1 | 241 | Energy | | | |
| AT1G12350.1 | 242 | AT1G72700.1 | 443 | | |
| AT1G12780.1 | 243 | Metabolism | | | |
| AT1G15380.1 | 244 | AT1G01390.1 | 444 | | |
| AT1G16540.1 | 245 | AT1G01420.1 | 287 | | |
| AT1G17420.1 | 246 | AT1G02400.1 | 227 | | |
| AT1G20630.1 | 247 | AT1G02660.1 | 228 | | |
| AT1G22400.1 | 248 | AT1G07240.1 | 445 | | |
| AT1G23870.1 | 249 | AT1G09350.1 | 237 | | |
| AT1G34630.1 | 250 | AT1G21050.1 | 446 | | |
| AT1G35580.1 | 251 | AT1G23870.1 | 249 | | |
| AT1G49530.1 | 252 | AT1G24280.1 | 447 | | |
| AT1G51760.1 | 253 | AT1G26380.1 | 448 | | |
| AT1G53580.1 | 254 | AT1G30620.1 | 449 | | |
| AT1G56600.1 | 255 | AT1G30820.1 | 450 | | |
| AT1G58180.1 | 256 | AT1G60140.1 | 451 | | |
| AT1G67070.1 | 257 | AT1G60470.1 | 452 | | |
| AT1G67980.1 | 258 | AT1G64500.1 | 453 | | |
| AT1G68020.1 | 259 | AT1G67980.1 | 258 | | |
| AT1G70290.1 | 260 | AT1G71697.1 | 261 | | |
| AT1G71697.1 | 261 | | | | |
| AT1G72330.1 | 262 | | | | |
| AT1G72520.1 | 263 | | | | |
| AT1G72680.1 | 264 | | | | |
| AT1G73880.1 | 265 | | | | |
| AT1G73920.1 | 266 | | | | |

Table 2. *Arabidopsis* Accession numbers of promoter sequences of genes which are upregulated under the indicated stress conditions. "At"—*Arabidopsis thaliana*, followed by the chromosome number and the "g" for location of the gene on the indicated chromosome. Sequences of the promoters include genomic sequence 3000 bp upstream of the 5'-UTR of the indicated gene.

Table 3, below, provides a non-limiting list of stress-related genes of *Arabidopsis Thaliana* which are upregulated during various stresses (light stress and osmotic stress), along with the promoter sequences of the indicated stress related genes.

TABLE 3

Light and osmotic stress related promoters

| Light stress gene | Light stress-related promoter SEQ ID NO: | Osmotic stress gene | Osmotic stress-related promoter SEQ ID NO: |
|---|---|---|---|
| | | At5g52310 | 394 |
| At1g07890 | 584 | At2g39800 | 616 |
| At3g09640 | 585 | At2g33380 | 617 |
| At1g02930 | 586 | At5g15970 | 618 |
| At2g47730 | 587 | At5g47640 | 619 |
| At3g09940 | 588 | At5g15960 | 393 |
| At1g19570 | 589 | At1g60190 | 620 |
| At3g22840 | 395 | At1g20440 | 386 |
| At1g08550 | 590 | At1g79520 | 621 |
| At1g06570 | 233 | At2g22240 | 622 |

TABLE 3-continued

Light and osmotic stress related promoters

| Light stress gene | Light stress-related promoter SEQ ID NO: | Osmotic stress gene | Osmotic stress-related promoter SEQ ID NO: |
|---|---|---|---|
| At5g52570 | 591 | At2g17840 | 376 |
| At1g74310 | 592 | At4g34000 | 623 |
| At3g09440 | 593 | At3g61890 | 624 |
| At2g29500 | 594 | At4g19170 | 625 |
| At5g42020 | 595 | At2g28690 | 626 |
| At5g56010 | 596 | At2g45820 | 627 |
| At5g56030 | 597 | At4g34010 | #N/A |
| At5g56000 | 598 | At2g37170 | 628 |
| At5g22060 | 599 | At2g15970 | 403 |
| At2g46830 | 314 | At1g64780 | 629 |
| At5g65070 | 600 | At4g27830 | 630 |
| At5g41410 | 601 | At5g57050 | 631 |
| At1g04400 | 602 | At1g79270 | 632 |
| At2g37040 | 603 | At2g24540 | 633 |
| At5g13930 | 604 | At4g25490 | 410 |
| At3g45140 | 605 | At4g22200 | 634 |
| At5g11260 | 606 | At4g27410 | 635 |
| At4g34230 | 607 | At1g01470 | 385 |
| At1g68850 | 442 | At1g08920 | 368 |
| At5g20230 | 608 | At3g51900 | #N/A |
| At3g21720 | 609 | At4g35770 | 636 |
| At4g15210 | 610 | At1g20450 | 387 |
| At5g24770 | 611 | At1g22710 | 637 |
| At5g65760 | 612 | At1g72770 | 638 |
| At3g17800 | 613 | At3g47340 | 639 |
| At5g61820 | 614 | At3g21670 | 640 |
| At1g19180 | 615 | At2g38800 | 641 |
|  |  | At1g05340 | 642 |
|  |  | At3g47430 | 643 |
|  |  | At5g61790 | 644 |
|  |  | At2g02810 | 645 |
|  |  | At4g08950 | 646 |
|  |  | At5g08610 | 647 |
|  |  | At3g10520 | 648 |
|  |  | At2g27690 | 649 |
|  |  | At2g30590 | 650 |
|  |  | At1g59990 | 651 |
|  |  | At1g65390 | 652 |
|  |  | At2g31730 | 653 |
|  |  | At4g12730 | 654 |
|  |  | At2g38310 | 655 |
|  |  | At4g22470 | 656 |
|  |  | At4g12420 | 657 |
|  |  | At2g34300 | 658 |
|  |  | At4g30800 | 659 |
|  |  | At4g26200 | 660 |
|  |  | At1g10020 | 661 |
|  |  | At2g33210 | 662 |
|  |  | At4g27730 | 663 |
|  |  | At4g37450 | 664 |
|  |  | At4g02330 | 665 |
|  |  | At2g28570 | 666 |
|  |  | At5g39580 | 221 |
|  |  | At4g25810 | 667 |
|  |  | At4g21410 | 668 |

Table 3. *Arabidopsis* Accession numbers of promoter sequences of genes which are upregulated under the indicated stress conditions. "At"—*Arabidopsis thaliana*, followed by the chromosome number and the "g" for location of the gene on the indicated chromosome. Sequences of the promoters include genomic sequence 3000 bp upstream of the 5'-UTR of the indicated gene.

Table 4, below, provides a non-limiting list of stress-related genes of *Arabidopsis Thaliana* which are associated with expression of ABA hormone (which is upregulated in stress) along with the promoter sequences of the indicated stress related genes.

TABLE 4

ABA-related promoters

| ABA related gene | ABA-related promoter SEQ ID NO: | ABA related gene | ABA-related promoter SEQ ID NO: |
|---|---|---|---|
| Transcription factor |  | AT4G18120.1 | 533 |
| AT1G06180.1 | 55 | AT4G25500.1 | 188 |
| AT1G09710.1 | 488 | AT4G32440.1 | 534 |
| AT1G09770.1 | 489 | AT4G36960.1 | 189 |
| AT1G22640.1 | 56 | AT4G37120.1 | 190 |
| AT1G67710.1 | 490 | AT5G18110.1 | 194 |
| AT1G72650.1 | 57 | AT5G23080.1 | 196 |
| AT2G16720.1 | 59 | AT5G46250.1 | 535 |
| AT2G47190.1 | 60 | AT5G46840.1 | 536 |
| AT3G06490.1 | 61 |  |  |
| AT3G24310.1 | 491 | Transporter |  |
| AT3G30210.1 | 64 | AT5G13580.1 | 537 |
| AT3G47600.1 | 65 | AT5G14940.1 | 367 |
| AT3G49690.1 | 492 | AT5G17400.1 | 538 |
| AT4G05100.1 | 68 | AT5G17850.1 | 203 |
| AT4G13480.1 | 493 | AT5G17860.1 | 204 |
| AT4G21440.1 | 69 | AT5G18840.1 | 468 |
| AT4G28110.1 | 405 | AT5G19410.1 | 469 |
| AT4G34990.1 | 70 | AT5G26240.1 | 539 |
| AT4G37260.1 | 71 | AT5G26340.1 | 205 |
| AT5G01200.1 | 72 | AT5G27150.1 | 540 |
| AT5G02320.1 | 73 | AT5G27350.1 | 541 |
| AT5G04760.1 | 74 | AT5G37500.1 | 437 |
| AT5G06100.1 | 75 | AT5G41610.1 | 438 |
| AT5G37260.1 | 78 | AT5G41800.1 | 206 |
| AT5G49620.1 | 494 | AT5G46050.1 | 207 |
| AT5G54230.1 | 457 | AT5G48400.1 | 542 |
| AT5G58900.1 | 495 | AT5G48410.1 | 439 |
| AT5G62470.1 | 458 | AT5G49890.1 | 543 |
| AT5G65790.1 | 496 | AT5G64560.1 | 544 |
| AT5G67300.1 | 459 | AT5G65990.1 | 30 |
| AT1G21910.1 | 301 |  |  |
| AT1G22190.1 | 80 | Protease |  |
| AT1G33760.1 | 497 | AT1G32940.1 | 209 |
| AT1G43160.1 | 82 | AT2G04160.1 | 545 |
| AT1G53910.1 | 83 | AT4G21320.1 | 211 |
| AT1G64380.1 | 85 | AT5G67090.1 | 471 |
| AT1G71520.1 | 86 |  |  |
| AT1G77640.1 | 407 | Protein synthesis |  |
| AT1G78080.1 | 89 | AT1G29970.1 | 212 |
| AT1G79700.1 | 90 | AT1G54270.1 | 546 |
| AT2G20880.1 | 91 | AT1G69410.1 | 547 |
| AT2G38340.1 | 92 | AT4G27130.1 | 548 |
| AT2G40340.1 | 93 |  |  |
| AT3G11020.1 | 95 | Plant defense |  |
| AT3G15210.1 | 96 | AT1G34510.1 | 549 |
| AT3G50260.1 | 97 | AT1G49570.1 | 550 |
| AT3G54990.1 | 409 | AT1G68850.1 | 442 |
| AT3G61630.1 | 99 | AT2G02100.1 | 218 |
| AT4G13040.1 | 498 | AT2G02120.1 | 380 |
| AT4G28140.1 | 460 | AT2G41480.1 | 551 |
| AT4G34410.1 | 461 | AT3G49120.1 | 472 |
| AT5G05410.1 | 462 | AT3G49960.1 | 552 |
| AT5G64750.1 | 413 | AT4G33420.1 | 553 |
| AT1G09530.1 | 102 | AT4G37520.1 | 554 |
| AT1G51140.1 | 104 | AT4G37530.1 | 555 |
| AT1G59640.1 | 105 | AT5G05340.1 | 473 |
| AT1G68920.1 | 106 | AT5G14130.1 | 556 |
| AT2G22770.1 | 499 | AT5G22410.1 | 557 |
| AT2G24260.1 | 500 | AT5G39580.1 | 221 |
| AT2G31280.1 | 108 |  |  |
| AT2G42280.1 | 501 | Energy |  |
| AT3G19860.1 | 111 | AT1G07810.1 | 474 |
| AT3G57800.1 | 502 | AT1G63440.1 | 476 |
| AT3G62090.1 | 113 | AT1G64200.1 | 222 |
| AT4G14410.1 | 503 | AT1G72700.1 | 443 |
| AT4G29930.1 | 114 | AT3G27870.1 | 477 |
| AT5G46760.1 | 504 | AT4G00900.1 | 224 |
| AT5G50915.1 | 505 | AT4G23710.1 | 558 |
| AT5G51790.1 | 418 | AT5G44240.1 | 559 |
| Protein kinase |  | Metabolism |  |
| AT1G06700.1 | 506 | AT1G01120.1 | 478 |
| AT1G48210.1 | 118 | AT1G01480.1 | 225 |
| AT3G17410.1 | 119 | AT1G01710.1 | 226 |

TABLE 4-continued

ABA-related promoters

| ABA related gene | ABA-related promoter SEQ ID NO: | ABA related gene | ABA-related promoter SEQ ID NO: |
|---|---|---|---|
| AT3G59350.1 | 120 | AT1G02400.1 | 227 |
| AT1G07870.1 | 121 | AT1G02660.1 | 228 |
| AT1G14370.1 | 507 | AT1G03090.1 | 229 |
| AT1G69790.1 | 122 | AT1G04220.1 | 479 |
| AT2G07180.1 | 123 | AT1G05560.1 | 230 |
| AT2G17220.1 | 508 | AT1G05680.1 | 231 |
| AT2G26290.1 | 509 | AT1G05790.1 | 232 |
| AT2G39110.1 | 510 | AT1G06290.1 | 560 |
| AT3G01300.1 | 511 | AT1G06570.1 | 233 |
| AT3G09830.1 | 125 | AT1G06800.1 | 561 |
| AT3G55450.1 | 126 | AT1G07720.1 | 480 |
| AT4G35600.1 | 127 | AT1G08510.1 | 562 |
| AT5G02290.1 | 512 | AT1G08630.1 | 234 |
| AT5G35580.1 | 421 | AT1G08830.1 | 235 |
| AT5G47070.1 | 513 | AT1G08980.1 | 236 |
| AT5G56460.1 | 514 | AT1G09420.1 | 563 |
| AT5G24010.1 | 515 | AT1G09480.1 | 564 |
| AT1G16120.1 | 516 | AT1G09490.1 | 238 |
| AT1G16130.1 | 131 | AT1G09500.1 | 239 |
| AT2G23450.1 | 134 | AT1G12240.1 | 241 |
| AT4G00330.1 | 517 | AT1G12350.1 | 242 |
| AT3G23750.1 | 518 | AT1G12780.1 | 243 |
| AT3G24550.1 | 519 | AT1G14290.1 | 565 |
| AT3G59110.1 | 520 | AT1G14520.1 | 566 |
| AT4G01330.1 | 521 | AT1G15380.1 | 244 |
| AT4G34500.1 | 522 | AT1G16540.1 | 245 |
| AT2G48010.1 | 523 | AT1G17745.1 | 481 |
| AT1G61420.1 | 136 | AT1G18270.1 | 567 |
| AT4G04490.1 | 139 | AT1G20630.1 | 247 |
| AT5G39030.1 | 145 | AT1G22020.1 | 568 |
| AT1G34300.1 | 146 | AT1G22360.1 | 569 |
| AT2G19130.1 | 524 | AT1G22400.1 | 248 |
| AT4G32300.1 | 147 | AT1G23870.1 | 249 |
| AT5G24080.1 | 464 | AT1G27980.1 | 482 |
| AT3G08870.1 | 525 | AT1G28580.1 | 570 |
| AT3G59700.1 | 149 | AT1G30040.1 | 483 |
| AT4G04960.1 | 150 | AT1G30620.1 | 449 |
| AT5G01550.1 | 151 | AT1G31480.1 | 571 |
| AT5G60270.1 | 152 | AT1G34630.1 | 250 |
|  |  | AT1G35580.1 | 251 |
| RNA binding protein |  | AT1G35910.1 | 572 |
| AT1G03457.1 | 526 | AT1G49670.1 | 573 |
| AT1G09230.1 | 159 | AT1G50480.1 | 574 |
| AT1G13190.1 | 160 | AT1G51760.1 | 253 |
| AT1G20880.1 | 161 | AT1G53580.1 | 254 |
| AT1G22240.1 | 527 | AT1G54340.1 | 575 |
| AT1G27650.1 | 162 | AT1G55020.1 | 576 |
| AT1G29400.1 | 163 | AT1G55850.1 | 577 |
| AT1G32790.1 | 528 | AT1G55920.1 | 578 |
| AT1G55310.1 | 165 | AT1G58180.1 | 256 |
| AT1G65660.1 | 168 | AT1G60140.1 | 451 |
| AT1G69250.1 | 428 | AT1G60440.1 | 579 |
| AT1G76460.1 | 529 | AT1G60470.1 | 452 |
| AT1G78260.1 | 429 | AT1G63180.1 | 484 |
| AT2G03640.1 | 530 | AT1G64660.1 | 485 |
| AT2G21660.1 | 171 | AT1G65840.1 | 580 |
| AT2G42890.1 | 172 | AT1G67070.1 | 257 |
| AT2G46610.1 | 176 | AT1G68020.1 | 259 |
| AT3G12640.1 | 178 | AT1G68530.1 | 581 |
| AT3G13224.1 | 179 | AT1G70290.1 | 260 |
| AT3G13700.1 | 531 | AT1G70980.1 | 582 |
| AT3G20250.1 | 181 | AT1G71170.1 | 583 |
| AT3G52120.1 | 532 | AT1G72330.1 | 262 |
|  |  | AT1G72680.1 | 264 |
|  |  | AT1G73880.1 | 265 |

Table 4. *Arabidopsis* Accession numbers of promoter sequences of genes which are associated with ABA expression (i.e., upregulated when ABA level is increased; "AT"—*Arabidopsis thaliana*, followed by the chromosome number and the "g" for location of the gene on the indicated chromosome. Sequences of the promoters include genomic sequence 3000 bp upstream of the 5'-UTR of the indicated gene.

Example 6

Transgenic Plants Expressing IPT Under the Metallothionein Promoter Exhibit Increased Tolerance to Salt Stress Experimental Methods Induction of Salt Stress—
One week old seedling of two lines of M-IPT, one line of SARK-IPT and WILD-TYPE were grown in growth chamber at 16\8 (light\dark) at 25° C., in Petri dishes containing 150 mM NaCl for three weeks.

Experimental Results

M-IPT Plants Exhibit Increased Tolerance to Salt Stress—
To test the effect of the M-IPT transgene on salt stress, one week old tobacco plants were grown for 3 weeks in Petri dishes in the presence of MSO growth medium with or without salinity stress (150 mM NaCl).
As shown in FIGS. 17A-D, 18A-D and 19A-D, while the majority of the wild type plants did not survive the salt stress (i.e., failed to grow) and those which grew exhibit relatively small leaves (as compared to the same WT plants which grew under normal conditions), the M-IPT transgenic plants exhibit increased tolerance to the salt stress as shown by a higher survival rate of plants (as compared to the WT plants under the same salinity stress growth conditions), with comparable leaves size (e.g., as shown in FIGS. 18C-D. These results conclusively show that the M-IPT construct confers increased tolerance to a salinity stress.
SARK-IPT Plants do not Exhibit Tolerance to Salt Stress as Compared to Wild Type Plants—
As a control experiment, tobacco plants were transformed with the SARK-IPT construct (as described in WO 2006/102559) and wild type and transgenic plants were subjected to a salinity stress (150 mM NaCl). As shown in FIGS. 20A-D, under salt stress conditions most of the wild type (FIG. 20B) and the SARK-IPT transgenic plants (FIG. 20D) failed to grow, and those which survived the salinity stress exhibited a severe growth retardation, e.g., small plants with significantly smaller leaves as compared to the leaves of the same plants when grown under normal conditions [FIGS. 20A (WT) and 20C (SARK-IPT)]. These results conclusively show that the SARK promoter is not a stress promoter, since it is incapable of regulating the expression of IPT under stress conditions such as a salinity stress.

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

SEQUENCE LISTING (696 sequences)

SEQ ID NO: 1 - DNA, 2334 bp, Artificial sequence
  Nucleic acid sequence of the Metallo promoter-IPT-NOS terminator construct
gtaccgggccccccctcgaggtcgacggtatcgataagcttgatatcgaattcctgcaggcggccgcgaattcactagtgatgacgatgtttctgtgattgtgatttcacttgaaggaagaatttggagatcttccatgtgaatactaatcttttgaagagactcttactaaagtaacttttagaattgattcaatctttttagaatagattttttttttttttttttggatttcgctgaggttttaccattttgttactcagcatattttaacgatgttgcatttgtgtcccaatatacgttattgttagtgaaaaatataatgtaagaataatttatataactatcctactagcaaagctaacgcaaattttgaactcgaactttagttaccgtgaatgaaaataacagacttgaactttataatactcgtagtatacgtaatttttgctttttgcagatatgcttgccactaataaagtcataaattttatattttcataaactatagttatacacttttgactaaacaaacaaaatcggtttagcaaaagaaaaagttacttttctgatgaactaggataaggaattcggaactgaattttgctacgttctctctggaccacacacactgaacacccttttaagattttctccttctctttttcaacgtaatttatcttttgatcagaaacgacaaaaaagaagtctaacaatatcaaacaatttttttatagatatttttagatatttttcctgctaattttatctagtgtagacaaacccaaatatacgattattataaaaacacgaaataccaagtggacgactgaggttaatagatctagccgtagaataaagatctgcatgaaaggcggtgagaatctaaacggtgataagaccataacacacggaacatcggtacgctctcgaacgtacaagaatcgacgacacacaaacactccacaattatttgaacactggacaattattgaaccgacgtacgagaatcaatgcgctgagggtaaagacgtaaatgaagaactagttttggagataagagcggagaaagattgcgacacatgtatggtcaatattaatctcatttagcttataaatttgggagcttcctctatcattaattttcattcataaatttttcttcaatttgaattttctcgagaaaaatatcgaattcccgcggccgccatggcggccgggaggggggatctttctctaatataaaaatcagtttgtattcaatatactgcaaaaaacttatggacctgcatctaattttcggtccaacttgcacaggaaagacgacgaccgcgatagctcttgcccagcagacagggcttccagtcctttcgcttgatcgggtccaatgctgtcctcaactatcaaccggaagcggacgaccaacagtggaagaactgaaaggaacgacgcgtctctaccttgatgatcggcctctggtggagggtatcatcgcagccaagcaagctcatcataggctgatcgaggaggtgtataatcatgaggccaacggcgggcttattcttgagggaggatccacctcgttgctcaactgcatggcgcgaaacagctattggagtgcagattttcgttggcatattattcgccacaagttacccgaccaagagaccttcatgaaagcggccaaggccagagttaagcagatgttgcaccccgctgcaggccattctattattcaagagttggtttatctttggaatgaacctcggctgaggcccattctgaaagagatcgatggatatcgatatgccatgttgtttgctagccagaaccagatcacggcagatatgctattgcagcttgacgcaaatatggaaggtaagttgattaatgggatcgctcaggagtatttcatccatgcgcgccaacaggaacagaaattcccccaagttaacgcagccgctttcgacggattcgaaggtcatccgttcggaatgtattaggttacgccagccctgcgtcgcacctgtcttcatctggataagatgttcagatcagagggcgagctcgaattgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcagatcct

SEQ ID NO: 2 - DNA, 8 bp, Artificial sequence
  ABRE (ABA response element) cis element
yacgtgkc

SEQ ID NO: 3 - DNA, 8 bp, Artificial sequence
  Exemplary ABRE (ABA response element) cis element
tacgtgtc

SEQ ID NO: 4 - DNA, 8 bp, Artificial sequence
  Exemplary ABRE (ABA response element) cis element
cacgtggc

SEQ ID NO: 5 - DNA, 9 bp, Artificial sequence
  DRE (dehydration response element) cis element
taccgacat

SEQ ID NO: 6 - DNA, 5 bp, Artificial sequence
  CCGAC-core motif cis element
ccgac

SEQ ID NO: 7 - DNA, 8 bp, Artificial sequence
  Exemplary ABRE (ABA response element) cis element
yacgtggc

SEQ ID NO: 8 - DNA, 9 bp, Artificial sequence
  CE1 cis element
tgccaccgg

SEQ ID NO: 9 - DNA, 11 bp, Artificial sequence
  CE3 cis element
acgcgtgcctc

SEQ ID NO: 10 - DNA, 7 bp, Artificial sequence
  Exemplary ABRE (ABA response element) cis element
acgtgtc

SEQ ID NO: 11 - DNA, 7 bp, Artificial sequence
  Exemplary ABRE (ABA response element) cis element
acgtgtc

SEQ ID NO: 12 - DNA, 7 bp, Artificial sequence
  MYBR cis element
tggttag

SEQ ID NO: 13 - DNA, 6 bp, Artificial sequence
  MYCR cis element
cacatg

SEQ ID NO: 14 - DNA, 7 bp, Artificial sequence
  Exemplary ABRE (ABA response element) cis element
acgtggc

SEQ ID NO: 15 - DNA, 9 bp, Artificial sequence
  CRT cis element
ggccgacat

SEQ ID NO: 16 - DNA, 9 bp, Artificial sequence
  LTRE cis element
ggccgacgt

SEQ ID NO: 17 - DNA, 10 bp, Artificial sequence
  NACR cis element
acacgcatgt

SEQ ID NO: 18 - DNA, 14 bp, Artificial sequence
  ZFHDR; ICEr1 cis element
ggacacatgtcaga

SEQ ID NO: 19 - DNA, 6 bp, Artificial sequence
  ICEr2 cis element
actccg

SEQ ID NO: 20 - DNA, 3000 bp, Arabidopsis thaliana
atattatactacccaaaatgaatatttaccttattcttttgttgatcgctgcgacaagcaccggcggcacaaaatataaaagaaaaaagaaggaaagatgaaggtgagatgaatgaaagagtcgcagcgatagatctgaagagataggagaaagggaatttgagacgttgaaaattccagcgtctacggaatagccgaattacagtcgctgcggcaaagatgaaagagaggaaaaataaaagtgaaagagagatgagagctttttttagatcgcaggtagctgacgtagcgatcaatcaaagaacatggtcattatctaataaaaactatttaattagccattaggaaatttgaaggctagacttgttaaaaatcttttcgtatgggcccatccgtgccttcttcaatgggcttgaagaagtagacaagacatcccattattgattattttccttagcttgatgaatgtttttggagttattacatactacattataaatttcttgttcttacagtcagtatatacacaatctgcactgaagataccttaaaaagctagaacgtacggctttgctgaggtttgtttggatagagttgttaaatccaaattcattttgaagcatttagagaattcacaagaagcccaattatgattcaattagaagcccgcaaaaccatgtaattagaaatttctagcaagtttagattcacagaaatatgttgttataacttataagcatcaatgtagctaattttggaagttgccagccactatccacaactctccttcttcatcatttcaagacatcaatctaagatttactgattaagcttagcgttctttatttccccttgcactaaataaagctcttactgagttattttattttgtatctttgctatccatcttatattcagctcctttgagcaaaaatcgatcgtgatttggattctcccacaaatcctaggggagttaattagccacgtaacaactttgaaagtcaccagtctctccccattcctcatctaaatatcaaaagtcaaacgttcaaatccccttgagtccttgacgttaattttttgttatagaaaaacgaacggaaaaagaaaagtgagattagaagatcatttatagaagagaacaaaacaacgatggttgttatacgctcacaatcaagatccccttgatcaacatgttgctaaacgcagacaaggactcgcggagacaacaatggttgttacgtattcaaaattaagaaacaagctaagaaaaaccttcatattcttaagcatacattaaaggctacataatcaatagtactgacaacgatcataacttcaaaataatgcattaatcacttgagatttaccaatagttggattttgaatctcgagttctaactccaaagctgcattttcattgtttttttaatactcatccatcgtacggcgtttattatgcgatctaccacccatgtgcatgtatttatctcacttaatggttttattattcaattcttgtaattcctttttgtttttcaaaatgagatgatctaccacccttgtgtatgtaattatctaacttaagtatttcatttacgttactcatgataacactcgatgatctaaagtttagttacattttatagaatgctatacttcacttagatatcagatgtgggttcaaaaccataaaaaaatatataaaatcatgacttatattcaacgcattcgcggagacgttgatattgtttcacaaaaataggaaattaacacacgcgtagaaatattcatgtatctatttgtgttcatacaaattaaagatgtttaaaataagatattgttaaaaaaaaagatattgttaaaaaaagaaaagaaaaaagatattgttataataagaaaaatataaatattgtcaatagtagcatgtaatatgagaaattgaatcaaacgtaaaatcgtgatcataaaaaataaaattcaaaagtaaagaaaaacatgcattgtccattttttttaatacttgaatttgtttaataattaatcctcgagttacgtacgttcactagttatttccaatcgacaaacaaattcaacggtttcgaaaattctgaacagaaataaaagatgtagtttcatacaaaataaatgttagttttttattttgtttgtgtgatgatattcagccttccaaaacatatttgttggtgaaagacaagtttttggctgtcggtagtacgaccatttaaattaaggaaaatcaactccaagattcacggatgtataaaatccaccatttgaatactgccacgtggcagtagaccaccagaagacgtgtacaagtgtgtctcctcctctccatgtataaagatgaccgttgccacttgccagtgccacatatgatcgtcggctccggtgattttcgctctctctgcggccacacttgtttgcttggtctctttgtaatactttaacatcacttagtatattgcatgtttcattctttctttctctgattttgttttcgtgagatattaaagagttcataacatataatttcgatgtcagaccgtattaaaaaagttttttttgtggattagattcacgatgcattttaatcagtggagtttaatgaaagaattagattcttaataattttgggtacatatgcaatttcagattttctttgtcataaaaggaaaatttcatttctttttgcttgttttgtgcattgcgatgtttgtctaattcagataagcacatagcgttttcctattttcagctactaaagtacccaaaaaacataaagactttgagattcttctctacatagtgggtgaaaaaaagactacatcataaaaaaaactacacgatatgaagtcatttatatgtgttatataacttcctttgtgtgtggttaggtcatataaagacctgttgcaaaggctaacatctgatcagagcgacgtggtttagaatctccgagtgatttgaggggat

SEQ ID NO: 21 - DNA, 3000 bp, Arabidopsis thaliana
attacaaaaacaaactaatgtagctgtgaagatatgattaggtgataaataacagtcgtgcctgcaatcaagtcttatgttgttgattcacctattggtttgggtctttttaaaaaaagattaggagaaagtcgtcatgacgtgaaagccatgaacacaaaagagttttattctggttagagatgattttttttaataaaactaaaaccttaccttattctacagcacaacattgctttaccatctctggttgactaaatataattagtggtggtgtgattcgatttgtttgttttttcgactagtctttataaacaaagtgctatcagttagaataaaattgatttcgtttaaaattccggtttcggtttgagttcggttgaattaaataccggtctaaccgaaacctattggagttattttagtttcccgctacactatcatcggatttcccgccatcgtagagagccacaatcggaaagtcgaaactctctgctgtgtctctccctattttgctcttcttcttcttcttctcctcctttatcttcgttttttctttcctgggtttgctaagctacatccatttccttctcttcgatcacagtggttactgatatttcaatcttcgggagtttcgggcgtaggggaacttcatttactgtccgtgtgtagaatatcggaagagatcgatctgatcttccaggaatcacacaaaatctaaccaggtaaactcaacttcatatcactaatcaggaacaaatgattctctcttactatatccggcgtttcgtttacaagtatgtcctcagaatttgcgaaatttgattgttagatttgatcatcagatgcttttaaaggtttgctgtttcatgatgttgctgaaattggaagttgatatgtgctaaaaaaataaggaggaactttctgtagagtgtagataaagtgtttgattaaatgtctctaccaagtataatttttatcacgcttgcatttaggtctggaaactgagatttcttgagatacatcaatggctggccagactgatcctcatatttcactgttttctccacaagaggtctttattctcctctttacttgtatgcgtttcatgttctgtctgcaatagtttaattgattagctatattcataccaggttgagtttatggcagaggacgagctggtcgagattgttcctaatatgaacatggagcaactcaatttcatcagtgtaatctctcttgttttatacaatcctgtaatcatttcccttgtaacctattttgttaaccatgtgattaatatgttaatcaatgacagggcgatttcggtcggttcattcctcagattccgacaaaggtgcctctgtggcttgcagtggcactgaagaggagaggaaaatgcactttccggcctccggggtggatgtctgttggtaagacaatttcaaatttagcagataaatttcaaatgttaacgaacattaggtgcttaagtgttaactgtttcttgttgcttctttgtttgtgaactagataatttgactcagatcttggaagcagaacgtgaatctcagtcgacattccaggcattaccatttagttacgtggagattgccagactactttttgaccagtaggttcttagactcttcttgtttctttgctcgcccttacatttataacatccaagagtgctgatgagtatcgatctcacttttggcagtgcacgtgacgatattccagacatgtatatggtaatttcatacatcttaatttgtctcccatcctaactatgtgttcgaattaagcttttatagccgtttatgaattttgtataggtgagatccctagtcgaggacatcagagatgtacggcttcacaaacttgagactaacttaggatcatttcaaggtacatctgcagtaaaggtaattgttttttattgctacttcttgacattagctttttctcattacctctaaagagtgatttttaacaataacaatatctctaatttgagaatgtagatctctaatgtatcggcaatggaagtaaacatagtacgcccatttgtgataagagccttagaagcattttataagcatgacaagccagaggctgatgtagacagagacaccagaagtagtagacaacagcgtgaaaccaacaatgaaccaagggtaaggctcttcagtcttcacacttctcactcgatttttccccctttttttttaagacaaatacaaacctcaacacatgttttgcagagacctctaaggcaacgctaggtagcttccacgcccttgcctaagtgagtagaagtcaggtatcttctgtgccaacgttggtcgaactccctgagaagttagaacaccagcagcatgtatcggtatcgttaatatatgacttgtttctcctgcattgtggtacatactcctttgatattagcatcttttatgttgtgacgaaaagttcactttaatgaacagaaatattaagatggcaaacgagttttatgggtgaaatggtcacacgaaggatcccatatgttttcatttcaagtatgtgggctgaaatcgatcaaacacttctgcaaaatgagctcagtgttttttttttatgtgatacacaatttactggagagcacaaaaggttgaaacatacgaactcataaaccagctagtttaatgtgacaatctaagtatgaaaaatgattgaattttaaaactgaaagaatgatgaacctgaatcatgacaggatatttagagatggtactgttcaagtcaaggcttatacttaacagtaatcaacgaaacatactgattaattaagacacgcaatgatatgattaatgatcaagataaagttatgaatgtagctgccatatcgtccttatccatcccaaactggcactacgctatgctctgtttcttcatgctacaatcagtgatacgtctttcttcacgttgatcacattcttctctatcccaccaattccg

SEQ ID NO: 22 - DNA, 3000 bp, Arabidopsis thaliana
aagagttgataccatggcagaaacataagcaggagatggcaacaaagatatgaactctctatgactatcaaaattgaccagagtagataaaatctacatatcactattaagtggcaaaaggtgtagaggaactataaatggccagggttgttttcagaggaagaactaataataataataatatgattggccaattgccaatcctatgcttataacatgaactatgaatgagaaggcaaaaacctgagctagaattcttacgcacatggtgatttcagacaaacagattcataacataaatttaagttgataaagcagactaactcgtattttgaagatagtatcctcaagacaaatagcgctccataaacttgtggtttttgcaagttttgcttcacccagtccaggagttcgggccattgctcaggatagtcagcgtaaattatggtcttcaggcactctcccatctgaactctgcatcatacacaccaataacgagcaagaataaggaccaaaaacagaggctagctttcctatctatacttcattgttaacatgtatgtgtaaatcaagcccatttcactctacataacacaaacatatcagtccgtagacaaattaaccaaaaaaagtagattggtcttaacgactgctgcaaggtgtacacaaactgctacctcaaaatcgggggcacttgagagacaaatacaagaatctggttcctgacaacattcttatcacttggcaagattatgttctggtcacctgcataacaaaacaaaaacaatgtaatccaagcaaacaggtaacataacaatatttgattaataaacaaactaaataaacaattaccagaatgaggttcccagtgcttagcaatgaaattcttgaaatggatactagcagattggcgtacagaaagatcagagccaccatcaacaattatttgcaatatccttatcaaatgctgtggagtgtgctgcaactgaaaaaaaaaaccgaaatttcaatcagattttaaaccttaatagcagataatacaaccacagtcaaatcaagtcaatctaatgaagaaaaaaaacatcgatactccgaatttggataagcttagttctatcacaattctaaaataataaagagagaaattgaactaagcagagaggaaggaataaaaaccagaaaaagaaaaatttggtgtatacctgattaaggctctgctcagcagctctgcgctcgtcaggattgggactgaaagcagccgcgccaacgattaaagcgaggctaggcagatccatcggggaattcacaatcggaaagtcacgaatttcaagtctcctcccggaggaaatcgacgagactcgagagagtcaaatcaggaggaagaagagacgacgaagacgaaagagagagagaggtataagagaagaaggtctagggttttaaatggttcgttggtgtggttaagtctctctctctctctctcaaacgcgcgtggtaataagtgaaaaataaaataaaaaccagcacgtgacacacacaatacaaaaaccgagactttgcctggagctagtagtccttcacgccttactagtttacacggtcgatggacgcttttgttttttttggtccgtaaataattgggtttattatgtagactattaaacaaatattataataacaggacaaaatttcaaaattattcaataaatgaattgattgaattttttcactattttttaatttcttatttgattctttaatgattatattcaaaatagtaatatcctaacttcatatttaaactccattatgatcatggataggaatgaatttgtgaaaagtacataaaataattaaattagaaatatcctaaagaaccaaatgatattaatcataacaaaacaatacttctatacatgcaaatactctaattggagtatgttgtattaaaattttaatatggtagggaacactatttataaaagatattggagaacaaaaactttttataataattagcttagaaaaaaaatgatgagtaatcttctgaatttagtgggccaatccgacctaatagacaactcattgatttcatcttacgtcaggtacagttcatcaaatgcgaattatttcttaaattttaaaataatagctacttctttggttggttgcaaatgggcttcaggagtagcgcgggataaaatgggcctgtagaacatttgatgggccacaattctcaaaagcttttcttcctctttttttcttttgttcactgctctcaaaagtcaaaagctttccttttggtctcaaaagctcattatcattagggtagaaaaaagagtacatataagtggtaagttgtagtactagtaacatattaaatattaattctgtgaaaagttctttgatcacagtctttttttaataatcattacttgataaattatctacgtggaaaacaatacatcttacccccatttcatttggaggatgtacaatgtgtcaatgtgagactagccgttggatgggtctactcacattcgttgaagaacattaggtactgttaaaacttacaacctttttctcacccaatgtgcatttgcatgtgacatgcctagtgttactctttatctttttacacacataagtttcagtgcagatcagatgtttctctttttacattttgtcaacaagtttcacttttagctatcgtttacaaaagaaaaagtttcaaatatacaagaaaaatattaatcggcagtaaaatctctaagtccatttacggtaaccagagaatggttgttacactatgatcatcaagattaagaccaaacagtcacaagagatcttaaccattgattcaattttggtcaacgactcgaactcccaacataaccaaaacagtcagtcgtaataaaaagacgccccggtaggcgtataacagaacaacaacaccaaaagaaaagggaaaaaaaaaacagaggaactaataaacggacc

SEQ ID NO: 23 - DNA, 3000 bp, Arabidopsis thaliana
atctcctcctccgtcaccgtcttcatatagtcggcgaagttcaactccctgttcatcactgtttactggctcttcccggcgttcgtaaagagtttctcacacgtgtgatctcacaccctcaaggtctcgctcagtgtgagcacacgctcacaaagctcggacttaatgtcgcacgtgaggcagttgatgacaccgcaggagccgctgagttcatcgcctctaacaacctccgcgacacagccgctatcgcgagtgcacgcgccgccgagatatacgggttggagattttggaagatgggattcaggacgacgtgagtaacgtgacgcgcttcgtgatgctggcgcgtgagccaatcatacctagaacagatagaccgttcaagactagcattgtctttgcgcacgagaaaggaaccagcgtgcttttcaaggtgctctctgctttcgccttcagagacattagcttgacgaagatcgaatcgaggccgaatcacaaccgtccgatcagggtcgtggatgatgccaatgtcgggacggcgaagcattttgagtacatgttttatgttgacttcgaggcctcgatggcggaggcgcgtgctcagaacgcgcttgccgaggttcaggagtttacatcgttcttgcgggtgcttgggagttatcccatggatatgactccttggtcaccaacatcatcaacttcatcgtaaccatactatagtctatacacacatgaaaatgtaaattttggagaagataacaaagttttatatttactgatccattctgtttggtgttttacatttgattgaattcgtataaatcaataaacaattggtaaaaatttaaactaaaattcatagaacattgatttggaagttttgataacaggggaaaagttgtgacaatatggtggagttggtaacagaaataagggtttggggacaatcaatcattgtggtttgtatgataatttcgtgttgtcctattggacctggggttgataaaccatcgagtccaacaagaacacaacatatgtacatatgtttggtgtatgcaaaatgttgtcttttcaaattttcagaaaagattgttaaaaaatataaatgcgtctgccgggagtcgaacccgggtctattgcttggaaggcaattatcctaaccgttggactacagacgcttttgcatatcgagcaaataaactatatatacatataaactttggatgttgaggttaaagtgagaaagattttaaaatacatatatatagatataatctatatatatatttttgcatccattttgtgaaataaatcctggagttgaaacttatttacaatggctgtcactggcttttaattattagttttttcagcaataaattgattaacaaacgaaaaacattccaaatatatttcaatcccatatatcacgcagatttttccaaaatttgaactagatttcagcaactatttaaaacaaaaaatgtttgacaacccaaaagacaattgcaatcccttaaaatgagcaaacgcaactaaatacatttcttatcaattcactaaatcttatttctccaaaatttgaactagatttcgacaactatttaaaacaaaattttgtttgacaaactaaaacacaatcgcaatccataaaatatttattttaattataaatttcaactagcggggtaccgcggtttttttttacaggacgggtttggcagaacgggtttggaaggacgttacttaataacaattgtaaactataaaataaaaatattttatagatagagataatttgcaaaattttatatatactagtttaaataaaaaaaattatctccgcggtgtaccgcgggttaaaatctagtctatatatacatttttgcaactattttgtgaaataaatcttgtagttgagaattatttacaatgattgccactggattttaatatttgtttttgataattagaaaaaaaatcttcgaattaaatatttgacatttaataaatttttttaaaatctctttacattaactacacgattggttactaaaataaaactttcaaaatatttaatatcatttaattactacaaaattatcattattgatattgtttttcttcatgactattacaattcaattataatcatcaaaccgcagagatatttgataacatttaattactacaaaattacaaaatatttagacaatgattcataaacatatgataaagaagatcaacattaataaaataaatgagctttttttacgggatgggttggcgggacgagtttggcaggacgagtttggcaggacgagtttggcaggacgagtttggcaggacgttacttaataacaattctaaactataaaataaaaatattttatagatagttacatagattgttacaaattacaaacttttatatatactaattttaaaatataaattgtccctacggtatatcgcgggtgaaaatctagtattattattattaaccgaaagaaatttctttcaattttaaaaattctgtcagttataatgaaaatgtaaaactgtaataaggatttaatatacatattaacatgttatattgatatgttattactattatccaatttgctttttctattactgtttgttggatgtattgaaaatttaagattgtctccaaaatcgattattttgaaattatatataaaaaataagatttaagagatttgtttccaaaatattttgaattctccatttattttcatattctatcatatattttttaaagaaaataatcaagatatacacattttataacttcataaatcgtttgacacagaagagaatcgataaactataaatctgcaatgtttaatattattacgaaatgcttttaggtaaaagatgatatgatagcaagtgtgttttttggacttataaaagtgagtagcacctagtggggggagagagagagaaagagaaacaaagagagcgataaagag

SEQ ID NO: 24 - DNA, 3000 bp, Arabidopsis thaliana
agacatatcaatccatccacggaagcggaaagaagcttgttgggcttgttaggaacaaagtgtacctataattaagaacagagttgacatctataaactaacaacaaactagttcctttcccgcttgagcagaaagaatgagagagcaacaaacctgagtgacgtcgtccatgtgggattcctctaaacaagcaacttgctttgagtttctccagtcccacaaaagaacctgcaccatcgcttcagattgtaacaagctgaaacatagaaaatgctcaaaactagccttttttctttctcaaagtgtactcctttttaaacatttagagaaacaaaaaaaaaaacacgattccacaggattgagatgcctaacctgctctttgcatccaccagccagaagattatctgcagcacctccataggagaagctgaaaatctcctgatcattcccagtatcaatacgcgaaacctgaaacacccatgatcaacttaaattcaatgagttccgaaaatggaatcacatttacgacagaatttatataaaaaaaaaaaaactcacctgttggaaacttcgagtgtcccaagatctaatggtaccatcggaggaacaagagtgcaaaacgtgaggagacgccgccgagtcggaggaaaacgcaatctgattgacggtatcggagtggcctttacattcgccgtagtactgaccagtcaccggcgagtaaagcttgacggtgttggttgataaggaaaccgcgattgctgtccaatcgattctgtcacaaaaccagagttgggttcactttcagtaaactaattagtatggttatcgaaaagagagaacagaaagcttttactttgggacaatctggaagacgtagtcagagccgaagttggtctgaatagagttcttgagcccaaatttcttcacgttttgagccggagaagaatccgaaagctgacgattttgaacctccacttccatctccgacgacacttcttccatttgccgtttcagcgaaattgataagggttttaacggtctagggtttgttcgttgatcaaaacgaaacgaggattagcacttacctctctaagtcatagagaaggttataactctataggtcaaaatttaggcctgttttaaccttttcggcccatttaacgcacggtccaatacgattattagcccaaggaaacaacaaccaactcgctcgctcaccgtgcgcttcttctaaacatgtccatagaaacataaacatactaaaatgtgaaaagattaaattaaaaaacggatagaaacatatagaaagccacgtgatggtagcaaacagatttagtggttacaaccagatatcatttgatattgagatttatgaaaatgtcctttttcaatggctccgatcggtcagtgatcggatctaatattataaaggtgtgttgacccataacataatattattactaatacaagtaacatgcggtaattaactctatgtcgatcttttttctctgcatatatatcttttagtcggttttttcgttcttgctaatcgttatattcctctacacatggcaatggaaaagaaacgagtaacaacaacaagtagcctgcaaataattaagtgcgataagacaactctgctctgattggaaactgatattccggcccgtcccccttttattacgtaggagtaataaaattgggaacgtcaacttatattaatcatgacgacgttttctcaagggagcaaattgtacgttacgtctcatattatcaccacttttttgcagcaacacagttttatttcacacaatacaacaacactttatattatatatgagagtgatagaattttatcattccatatttccatgatataaagggttccaataattggtccaatttttctaataagacttttcttattctcatagactcttcttattcatctttcttaatcaattcgaccaactcagtggaagacaaatctcacacgaccctttccactttttggtaactttattattaatttattagtatggtgtagttcctttctttcttctgctgatcttgtcaacaaaatactaaatttttcctaagcggctgtttatatattattaacaaaggtttccgcgtgtctcttgtttaactagtagactaaaaacaaatcgtaaactcgattttctcaaccaaatttagaagatactacggcatgtaattagctaatgataaaagattcgaattttcgttccaatggatttgtcttttcttttgcccaaaaccaagaatttgtcttctcttggcagtatttagctagacaacgcatatagctatatattttgtgtacactggtcaaggtcgtggatacgtcattaataatattatttccaataagtcctattaaaacattaaacaactttgagttttaaaacaaacttagtgtaaagaaaataaaaatagcagacagtttacgggtaagactagatgaccatatatgattgagtgcataaaacatcttttttctttctttttttgaaaaagcgaaactaaaagattattagttgttggaaatcagcttagcgtaatcttcgagaaaatgactctaatgctaaaatactgatttaatcaattttctaatggtttgacccaacagacttttttttttttctatcctctaataatatataatcatatagtagtaattatttagtagataatatgattaacacgtgaatagcaaagtttctatcatttttattcaaaaaaagattcataagtaataaaatgatagtcaacttttctttttctttttgtgtttggccttttgttgcagcgtcattgttgtacaccaccagtcacactattgtgggatgtgataatcggtaccttttaatgtcaggagcttctttcttacattttccacttcaaacaaaccgataattcagaggaattttctcttcctctctctctctcttttttatattttttcactgggaaaa

SEQ ID NO: 25 - DNA, 3000 bp, Arabidopsis thaliana
tattaaaaaatggtatgtctacatacccttttgttttcttctacttttggctttaactttattctttttcttttgtctaacttctttttaccccactattttcataattaacctcaaaaagtcaaaatggagctaatttagggtgtttgatttggtacaggaataacaatctggggatgtggactactactggatcggaaggtactagcggtttagattcttataatgactataccgatgaaatgtctggcgctggttcaaccaaccggttatctttttcagttcttgttttcttgctaagttcgatatcatatttggtcgtgttcacttcttcaacccaaatgtttatgttgtaacatgaattgaatttacctattttatcaaggaacaagcaaaaagttgtttccatactcattcttgtgcattcttttcttctatgatctttatgtagttttaatggacctcataatttgtagttttacaaaatgttatagttcttaataataataccacgtgtgtgtttattgtatacgtatatgcaatcgtgacgttgtaatagtcctatcctatctttaattaattacataactaatagtctaatagagattagatattaatctttagcattatattatcttcttccttgtcttttctaatatacaagagggcgttccatacatgcatctacacttcattcggatcataccaatataatctactttaggatattgtaatttagtatattgaacattaaatacttttcccttgaaaaaataaaatataaaacatttttaacaaatcatttggcacaaaagtacactaaaacaattaaaattaattcatattaaaggtgaagcccatcaaccaataatgttaacataaaaaaacttataatttttcatcattggagcatggacttctcatgtttttgttgctgtatataacaagactatacacatcaatgctatatttttacttaatttgttattatggatatgtacctttatttttattttattttattttgtttaggaaattgtttattgtgtgaagattaacaactttatctttgaccttgactaaacttgcgattcaaatttcatattgataaccgattcaaattgagttcaaattttacatatttgtgtacattaaggttgaatattggaacacttgttactttaatatagcactttcgaattcaattatccatcagttaaaaagtaaataaaccaactttagaattatgaccatagagaacatgaaaactcctcaaagtccctagtctcttgaaaccaccaagtaccaatgttaatattgttctcactgcagctattgctgctgtgatcttctgaaagatttgcttcactctggtcagtagaaatctctgatatccaatccgaaatccgattttcatacggtgatttcataacaccgaagctttctcttccaccaacaccaccgttggcttctttaccactttccatgctcacaacttcaacaaaaccatgttcttgagacgtcgtctttgtcctagtgatctctgtttccttatacttgtgcaacaattcttctcctgtatttcctctccactcaaagagctttcctgcagaaaaacacatcatttttttcaatgaatgcttatctaaaactaacatacatatgcaacaatgaaagaatatctaccatagttttgagcttcctgtttctttctataatgagttctccaatagttctttatctcgttatcagtcctaccgggtaatcttctcgcaatcttcgaccacctattgatatacaatatttgattaatcaaaccgcaaaaaacaatcatgtaagtacaagattcaagggttttttttgtctctcacttgttaccccatagagcatggagctgaaagatgattctctcttcttcttgactcatcggtccacgcttcagagtcggattcagatagttcatccaccttagcctgcaactcttaccactcctcttcaaacctatacgtatgaacacaacaaacatatatttcggacatgtaaatttctatttttggaaagtgacacaaaataaggtttcaaagtgtaccggaaactattgctaaagaatcccaacgacgttctcccaaaagactaatgaccttcactagccgttcgtcttcttcttcgagccatggccctctacgaagtgtttcttccttcttaaaatccatttttctttcttttactctgtttctttgtgttattatacttaattaaatcctttctaaaattgtgctttgaacttgtaagcatgctttggctttgcttaaatagtaaagtcatgagtttacccaaattgggaaaaatgtccaaaaagctgacgaacacaaatagtttagtggataataacatcatgcatcagttagttaggttcttgtttttccttgatctaggtcatcttttaagttatagattatagatttggattaggttccaagtatctttccttttgaatcatcatcaacttgtgattttttattatcattgtcttcagggattatggctttcatcatcttaaaatttaattaactaatctaagtatccaatcgggtttggattttggaatttcaatatcttagggacttaaaaaagaagatagaaagagatgaaaccagatcttttttccactcacttaaaagtttaagccaacgaagcactcttaagtatgattagttaagtaaatcccagtgttaagcctaatctcatttttgcaacaaagagagtttaaaatcgacgcatctaattgagccggttaatgaaatctatcaatgttgaaaatggctttggttaaaatcggtttagactattcacatttcacgtgagactcagacaacctgcacatgacagtcttatctctgtttttgtcgttttcaagaaagtcgccacaagagatcattcgaactaaaaaaagcaaaacagatctctcctgccgtctttggttacttccggcggagaacg

SEQ ID NO: 26 - DNA, 3000 bp, Arabidopsis thaliana
ccatgagataacatggtgtaccgcaataatacaacgttacctatgaaacttcgagtagttagaaagttttgacaacacctttaatttgatttgaagcatgcaatcaccaaatctctagtaactactgttcaaaggttgcttatagtgtggccgagaggtatgccatcatcgacttcactattcttcgcggaaacaactcttttgcgatagatctcaacttcaccaatcggatctctttcatcgattagattgataaagttattccatgtcaaaggaaaaaaacaaagagatagttggattatcaagatgcatgaagtatgtggagtgcttttttaaaccaagtgaacgtaaatatgaatttgtatacataatacatgtgattagagttagtttaacataagtaaaaaagaaagttgaaactatcaaaatgctctgtgtaagtattaattatttcttccaacacacgatgtcagaagtcagaaccgattattaatacttttctcaacaacttctgtttctttatttatttttgataacttcgacgaggataagtaagaaaatggcttcctctttttcagtgtgtataatgcagttcttgactggactactctcaattggatatcacggattgtgaatacatattctcggttataacttttaactttataagttatacttttatttagtttcacaataagtgtggtttaattcttacaagtttgtatcaaaataggtattgttttatattttgaatgtagttacagtatttggtgaaattgcaattctattcttactattttaatgtattgaccaataaaaaaaagttgtataatatattaataagagataaacaaaaaaaatgtttttactatatgtgaagaacctgtaaatgacattgtgaatacatatattctcggttataacttttaactttataagttatacatttctttcttttcacaataagtgtcgttttagtgttaaaattttatttcaaaataagtattgttattatttttagtgtagatatttggtaaatattcaattttaatgtattgaccaattataaaaaattgtataatatattaataagcgatagacaaaaaaatctaattgtttttttactatatgtgaagaacctgtaaatgacatttatactaaaacgtaaaaagtatgtatgatatattgaatcaaaaataatactagtaatcagtagttaagttacatctattttgttaacgaaatagtaaaaaaaaatgtcattaagagacggatttattattgatatcaagtagagcaaaatttgtttgtttagaaacacaaacaaaatcttaactttggcggtttagtctgactaatttcaaatttatgttgtggagtatataaagtcgatagtactttttaacaatgattttgaaaactaaaactttatgttattggagtattatcatggattggagtttttgtcaatgaattaacatggagatgtggattaggttaggttcatcgagatatgtatttaaagttgaaacatgtgttttattattattcttttcatttatttatttttttctttctgtcggtcagtattgaaacatgtgtttagtttcatttgtcctctcaggcctcagcatgtctagtctaggagtattctttatgtttcaaaatataagaggttttagttaaatatgcagattaagaaatatccatttttaaaaaaattcaaccattcataaaaatatcatataatataaataattataaaatattaaattaatctatagttatgttacacaatttacataaatcacgctgtcatgagtagtctttttcatatatcatctattgacaaaataacaatttatcttgttgttcttttgaaaactagctattactacatatattatacattttttttctcataagtggtttaacgctgacaaaaaaaatctattgtaagatggtaaccactgaaagccatcttaggttcaatacttaaataaatgatatgatattaaaaatattgatcatggaccgatgtttatcgatttgagccaatgcaatcaatacgaagagagacttttattccttattctttagaaatgtatatctcattttatgactaattaaataataactgatgatcagtatgtggttctatacatttaaaaatcttctaattcagttttttttttttttttggtatcgatgttaagtatttataccgttttcaagtttgagacagaatacagagtaaacaatagaagcaaaaaaaaaaaaaaaaaaaaaaaaagggagaaagactacgactaaaggaactacgaatacaagagataacacgataagaaacacaaagcgaagcaactagtaaaggcttgaagaggaaacaccgattctaattcagttttcatatctgtttgatactcttaaggtattatattgttctgtgttccagttctatctcatgctaatcaaaaatattgttaataccactcttgcctttttcaagaaccgacatgatttttaagttttaaccacaaatgtatttgattggtaaaaggttctaaaaagtttcaacaactcacaaagccttaaaactgaaccattcatgttttacttttctttttaaggctatacaaccaaaacaaactttatgttgtctaattaatttctctggcataaaaaaaaaaaaagactccacaactaaaatcttttaagtacaaactacaaataggaaccaattattagttactagttaggatgcatcttcttcttacacgtgctgaattctatcttttgacttaaatgagtgagatgataaaagtcgaaaacgatttcgcttttatacgcggaagcggaaacgtgtttattttcttttcttcgagtcgcgacgtcgcatatattatttatcaaaatacaaattttattatatcaaaatcataaagctaaataaatacgacacaacttccaacattttctctaaccagaaagaaaaaaaaa

SEQ ID NO: 27 - DNA, 3000 bp, Arabidopsis thaliana
ccgatgataatgtgctgtgacagtaagtccgctatctatatcgctacgaatcccgtatttcatgaacgcacaaagcacattgagatcgattatcactttgtgcgtgatgagtttgttaaaggtgtaatcactcctcgacatgttggcacaacgtctcaactcgcagacatcttcacaaagcccttaggacgtgattgtttctcagcattcaggatcaagttaggcatacgaaatttgtatgctccaacttgagggggggtgttggagttggagatttcgtttaaaggtaaaccgggtttggtttagctacaaagttacgtgaagaggaagttggcgttaaatcagcaatatgtatcagattcattccataaaatctgcatcgttaatattgtttttatattttctgtgaagatacgatattatgataacatagagatcctgttctctaaaaactatatatgtacatgtaatcgttcataataaagatcagagaaactctgtttatttcataaacgatattattcatctattggtcctatgttttatgacttttgtggaggtttcattcggaaagcaaagtacgcacaataatacacccgctctctcagccgttggatcgtgttcatatcatttagtctgcggtggaggctgggaaagacagcctgtacaaagaacattgccagtaccaaagagataatgttccaaagttcaaatttctgtctttttcgaatgtgataagcaaaatgtgataacctctcccgcaaatcagatcgatagctcaaaaaatatctattattgatgtaagatagagactcgtctttatcaatatatttcttctttgtccccaccgttttaaattatacaatttgcaagttgcgtgactttcaccctacatgttctcatattcctcatatttacgtcaccataagtttttgccctaccgcatttatatcaatttcttaaccgtaatgggccatttcaaattactattctaatttggaagttttcaaaaagttatttttactcaaaataaaattattctaagtatattacaaatttttcaataaaataaattcgttatcacatactggaaatataatactcaggctacaacgtgataacgaatttattttattgataatggaaacagaacatggtttcttacgattatcttaacaaagtcttaattatctgacaaggtagctgtaaacgattccacgccgtacattaaataatctctttctcttataagatctgttgagcacgatggcttcgacgtgaatatagacaaaagtggccacatatattttaccaagataaagtaagttgaatatgggtattttaactttaaattatttatcatttataattttataatgatatattacacgttttctatatattttcgtaatgaagtctacgttatgattgagtgttgctttgaaagtttaatttatacagtttatggcagagtttaataaggttcctttaatcatcaagtctctctcagattcgttaatttttgtaaaagagtaaggactagaattcggaaagtgtgaatgcatagacaaatagaagagtttttcttatcgcacaaaatgttatctaggattcccgaaatcacggatgttgctattggccatcccaattagttacatactatataggttctttgttgatgagagagagtctcccctcatgtgtaactcttattggctctcccttgtcccttgctttggttttcttggtagatatggacatatggttaatttcatcttaacactaatccatgtccttttttcaaggttggtttgtaatgttcctttataagtataaatatacaatctccagacaaaaaaaaaaagagttcaaggttggtttgttacgcgagttttgacttccacaatctcgtttgataacatatccatgattttatggtattcggacgattttttattttagtatagacaagaattgtgacggtcgaaattcgatgttacaaggatgtaagctgtttgaattctttttagtgttatttgaaataaaactcaaagattaaaacaatattattttgagtaaaacactaaaacttaatatataatttttttaatttaaaaaataaaatgtcaagtttgaaatatatttgattaaaaaggatcaaaacaaacaaaaaccctcataggtcttcaatgaaattcgtattttagggtagccacaaaaaagttgggaacttagcttgcatctaattaatctgatttaaaaatatatatttgattaaactgtttctttttaaatatgatacgaaaatattatgtgtaaattaataacgatattatttcagtgaaaaaaagttaagttatacataatttgaattgaaattaagtacttgaatcatgtcaggtacgaccgtacgagtatccaaaaccctaattttttttttctccaaaccccaattttagtacccaaacatccaattcgtatgattgctaaaaaaaaaaaaaacacacatgcattcgtatcagctagtaaattacacgatctctctgtatctaaatttttccggatactaaaaaattgcagaattgatcggaattaagtaatactagatctaaccgtatataccagaagatgcatcaattcccaagttggccacatacaattatttcaaacgaccggaacaaaaaaaagaaaaagaccaaaccattagcacgtcgtattttaatattcttttgtcataatacatacacggtttatactttatacatacacctactttaacccgtacatgtcggcgtcgtacctttcctggtctcattccacatcttataattaaaatatacaacttgctaattgttactaattgttcacaaaaatgtcaaaacctaattaataaaacaaaacacgcaaagcataaaaaccctttaccttttctcttctataaaaccgtccatacggacaagctccacgacccacacacactttctcatcttctttctacaa

SEQ ID NO: 28 - DNA, 3000 bp, Arabidopsis thaliana
tcaaaattttcattattatgatccaatatatatgattgatcttgtattactaactttgctttatacatattgaaatatcctatcttttatcaactctacatggatgatataacactatatatattcgagattgttatcatatgcaactcaaattcgatttcagtttaagaacaaaaaacaaaaacaaacaaacaaaaagtgggagaaagataggcttgccgaatttgagatgggaacaaaagcttgatcatacgtgtgtggaggcaaagagagccagctattatatgttgatcagatttagaaagaggcagtctcatgtgatctttgccaattcttcttcttcttcttcctttcctttcagttatttttgattgatcgtaaatttatataactttgatgtttatttcgttacttcatttctattataatcgagatgtgatattaaaaaaaaatctaaactcttgaggtgtgaatgaaaccctacaaaagagtttattttttttaaattattattattattattatatataaataagctagaagacaattcaataatatttttggattgtagctagtatctaattcttgataaaattagctattaaactattgtgaaaaccgatttgattatttagaggaggaaatgttaggaaaacatctgttcatttttaatatctatttcatacaagttcaataaagaaaaccacgtttatagtttataatgaaaatttaaatttgcatgtaaataataataaaacatattaaaaaaaaaaacttttaaggccatcatgtttacgaacatatacatgttagagtaccgaccaatcatgggaagaagatgaaacccacagacacatggattattcttaattatactattacttaataaaatccattaaagaatttgtccatgataaggaggatatatccgcataaaactttattatgctgatattgtgatatgcatcccaaaagttcagtttgtgatattgttgaatatacttcaaatctgactctctgacaatatctccatgtcttttaacccagtcgaactttaactgcaatatagactaaattaatgtcatgcacttatttgtatatatatgattgcaagtggtatatcatgcgaatttatgtaattgacgtagagtgggcgatttggtcacattttaacaaagtctcgtgtaccatgtatagaaacattcatacgtttaagaaaacacaaaaacttctgtcttctgtttataaatgaattagtgatatgcgactgtgtttgtgtatgtaatacattttctaatgatttagacttatattatcaacatgcattacatttcttttggggttttcccataaaacgtgaataaacgcgtatatacttcaaagaaaaattattttcattaatgtataatcgtttgattcgtttctagatgaaaaagacaatacctctccagaaagaagacaaaccttctttctttttgtgtttttttttacgtcaggaaaacaaaccttttttctctttcgactaatttattattaactaacagaaatgatatagcatcctgatgtcagaatgattataagaaaaaaaaaggtaacaaaatatcgtgaaggcattacaacttggttatacactacgttacttgataatataatattcatatatagtttacaaatcaacagagagatgttttttgggtggtaaattaaagaagaagagaagtcgtatgaaagtgaaagtcactgggtggcactagagagtgagattggagtgcaaaaagggagatacagtccccacatgcatgtgatgttcattcggatgattctgatttcccaaactctctagtcacttgcaaatccatttctgacgcatgctaaaacgtactacacggactacttaatttaaaatcgataaatctttaaaactataaaaaattatttcttatttacgtataataactacacaaactcacaatatattattgatgagagtcaatgtttatctcaaacaagtttaaaacgggttggtttatagggatcgtaccagaagtctagaactgataattgtacgctatatttagtcaagatgaatcttcacatcattgataattgaaaaattaaatagcagtgttggtgacttgacctgcgagtaaacccggtaaccaaaagacttgggattgtaatttttttaaaaatttctaaatattgttagtttattctttggctaaagttttgtcccgtactatgtacgggcttaatattagtatgtaaataattcacaaacaagcgcacatcgaagcaaataatttatggaaaatgtgtctgaacggtgatgtaaaaacatataccacctaaccaccacaaacatgcatcatccagatttatcagataatagtggaccactttttcatcataagacaaactagctcatactactaagtaaatattttccatatatagtataatattcatctacattcgatctttggtatctgaaattaccaaaagtaaaccaacctttgtgaatccaaaacctttttcttgtatattcaaagatgtattggaataatgcatatatatccgacatgtttactgaaaacagacattcaataaacccttttttttacctcggtgaataatgttttgtagcttcatcgccgcataaatttttaccggaatggttgattggtaaactaggactagtatgatgtcggttgaagcattgtcccatctttcaaaataccaatttcgaagatatgatgaaccggaatccagaaattcaatccggtccacgtaaaccaaatcttgtttaaatttttaattcgtggctggtaattaatcagtagacgtcactgtcccgttcctttatacatctcgtacggacgagagccacactataaatattgccctcctggctaatgccattttcaacacttacaagttttacaacaaacgtaatatataaaacattactaattattacaagaaacaatcagaaacatc

SEQ ID NO: 29 - DNA, 3000 bp, Arabidopsis thaliana
tatgtggttttagttatagccagatttgaagtaccttaaaaggctaaaaccagattcatcaacctttctttctagaattagaatctaaatgcaatggcttgtgaaagttttgtgttttgaatgttctgtttctgaaagaagaattcttgtagggctaagttcgaaattcttgagtagagatgggagcaagggctcgtcgaccgcttccttctcttatatgcctcgaacagaaggcgagatcttgcaaaatgctaatctcaagaactttagtctcagtgaactgaaatctgcaactaggaatttccggcctgatagtgtggttggtgaaggtggatttggttgcgttttcaaaggctggatcgatgagtcctctctcgctccttctaaaccggggaccgggattgtcattgctgtgaaaagacttaaccaagaagggtttcaaggtcatcgagagtggctggttagtcacatttcttctcactttttctcctcaagctactttttttgttatttcaagattgtcgcagagcctggttttgtggtttcagggagtgatcatcttttttcgttttttttttcattttgaaaacaacaggctgagatcaattatttaggccagctggatcatcctaaccttgtgaaactgattggatactgcttggaagaggagcacaggcttcttgtttacgagtttatgactcgtggtagtcttgagaatcacttattcagaagtaagttcaaatcttcaaagataaagaagctcatggaagaacttgttatacacaatggttaatctttctttcttttttctcataataggaggaacattctatcagccactttcatggaacacgcgggttcgtatggctcttggtgcagctagaggacttgcttttcttcacaatgctcaaccgcaagttatataccgagacttcaaagcatctaacatcttgctagattcggtatgacatgattgatactttttgtagctttggttttggatgcagtcagagaagtttatcttaatgtttctctgcatctgcagaactacaacgcaaagctttcggatttcggtttggctagagatggtccaatgggtgacaacagccatgtttctaccagagtcatgggaactcagggatacgctgctccagaatatctagctacaggtatatatgaacatgcattctctgttattatgatcaatgaagagacctccaacacttatgtttctgtcaaatttgaaaggtcatttatcggtgaagagcgatgtatacagttttggggttgtgttactggagttgttatcaggaagacgagcaattgacaagaatcaaccagtaggagaacacaatctcgtggattgggcaagaccctacttaacaaacaagagaagacttctgcgagtgatggatcctcgtctccaaggtcaatactcactaacccgagctttgaaaattgcagttcttgcactcgattgcatatctatagatgccaagagtagaccgaccatgaacgaaatcgtcaagacaatggaagaacttcatatccagaaggaagcatcaaaagagcagcagaatcctcaaatcagcattgacaacatcatcaacaaatctccacaagctgtgaattatcctaggccttcaattatgtaacaatcctaggcgagctatttaccgggttttagagatgtatagactctttaccttctgtctgtttagatattatgttgtttggtagtaacaaaagagctggcaatgtaagggagagaaggaaacttactagttgtaaacttaggttctcttacaacgttcacatgttatctcacatacaaaatgttatcaggataagaaaaccacaaaaaaaagaggcaaagaagtgagatgatcctagcagagaatcaatctctagttcatcgtcctaacaaagcaacacgatctgactgtacagcttgagtaaggttgatgtcgaaaagctcgcaacggataggcatttcaatctcatagaaaggattcttcaagacgtaatcagtgtagagttcataaatgtatctaaggaggctctccatgtgaggagtcccaggttcacaaaccacaaagaactttgttcctgagatatgatcagttattgagccaagtcagtaatcaagagaatgtgacggtatcttcttgcaaatggcgatgtatgattacctgggagagactggaaacaatggagatcgaaagtgtcggcttcgagaagctcgatgccagaacagccattgacaggtgaaagctgctgagaaatggcgtgcattgaatgccataaactagctactctcaagctatcattcgtatccattcttccctttgttccacaatcctgaatttttcccaaatccaaacacacacagaacagatcaaaattcaaatccaatttctttagtagctattcacaacccctagattaataccgaaaacactccttctactaaacctagtgatctcaaaaatttcatcttttggtctatccctcgaaattaacatcaattagctcgtcattctctagacatggaaagtccacaagctgcgagatcgagaacaagaggaagatggagagatcgtaccttgtagaatatcaaaccaccagatttgttaattatgtaaagactgtaaatcgctgccatttttttcccccgataatcttcaaagatccaaatccgagaaatcagcgagacgatgaagaacaacagtacagatcttattaatgatttttctttttctcaaaacggcgtcgttattatatcgatggtctctactcgcgccacgtcgcctaattaatttaacgacgtcgtcttttaaagaactagcgtctcttaaagcgccacgtgagctaatgtttaaaaaacttcaccaaaaatggtgtcgtttcaataacttttcttcaccaactaccaaaaacgtctgaagaagaaaaaagtataagtaaagcagagagaagagcaagggagaggtactaaaa

SEQ ID NO: 30 - DNA, 3000 bp, Arabidopsis thaliana
aatacatctctctagctagagaaaaagaaagcggaaataaagatataaaaatatttggaaagaaagatactgggagcaatttagctacagcatgacgatgagtcttactttgattctgtcaacattattaacctgagacaatcccaaaagtctttcgtcccaatattgaatcttctaattttgatatctatgtgattttgcatatgcactacctgagagaccaacagtacctagaggccaacttgtcctttttattcacctttcttgcatgacttttcctatgttgaaaagttagactcctcttttacacttcatgtaccccactcctatacgtatttaatctaaatatatatacccaccaatcctctccatctacacaaacagcccaaatatcaaacctttcatctctatatctttaaccttgactgcttctcttcttctacaagaaaccagaaaaaaagaaaagaaaagaaaaagaagagattagggatgggtttcttagagttgttggaggtggcttcaatgccaatcgttcaagttcttcttatcagcgtccttggcgctttcttggcaaccgattactgctctcttctctctgctgacacccgaagatccgtgaacaaggtcaacctccgtctctgcttttcttttttctgtttggtgtcaactatgcatgcattcatatatcatcactaacaaacattttccctcgcagctcgtcttcgtggtattcaccccctgcatcatgtttgccaaccttgccgagactgtcacattgcaggacattatttcatggtatgcactaccagtctcctatcatccctctgagaatacatacgtgtggctttgatttgaccaaaattagttttgtaggtggtttatgcccataaatgttggaatcacctttctagtaggaggcattcttggatggttggtggtcaagctactgaaccccaaacctcaacttcatggcctcataattgctacttgtgcctcaggtaacattaaaacctcaaaatttaatctcaaggaggagagatatatccctgaattctcacatgaatcatatttactgtcctgtctacgtaggcaatatggggaaccttatgcttatactggtccctgccatctgtgacgaggaaggcagtccttttgggaatcgtagtgtctgcagatccattgggctctcctacgcatctttctctatggccgtaagtcaaacatacatacatatgatcttctgatctctgctcagacttaattgttgagttgatcgtgtgattaatttttgtcaagggcagctcgggggtttctacatatggacgtacagttaccaactggtaagaagctctgctacacagtttagagctcttgaagccgccgggttggtcaagtctcccaacaaggacatcgactctgatccccacgctcttctcctcaagccgcaccaaaaccaagaccttgaaatccaaggcaaacaaaaagtgtctaccaggacatacatcaaggacttgctccatcagattcttgaggaactcttcgcaccacccaccattggtgccgtaagtctttttaaaaaaagaagacatgattacgtttccaaccaacaactaataaatccactgctctgatgcgttgttatatgttccattcagattcttggcttcgtcttcggagcaaccaattggctaaggaatcttataattggggagaatgccccgttgcgagtgatccaagactcagtaaagctacttgggtatgaactcatcttttttgaatatggaaattacaattacatcacgactttgcgcctaatagttgacttggcagggagggcacaattccttgcatcacactcatactggggggaaacctgattcagggtctgcgttcatcagctgtgaagaaatcagtgattgtgggagtgataattgtgcgctatatcctccttcccgtggtgggagtcggggtggtccaattagcaggaaatctaggctatcttcctccagaccctctctttcgatacgttctcatgcttcagttcgcactaccgcctgccatgaatattagtaattactcaagccatcccccttcacttcattgttagctagatacggatgattaatcatacactatatatatatggattgcaggcacaatggcacaactgttcgacgtggctcaagatgagtgctcggtcatcttcttgtggacctacctggttgcatctttagccctcaccgtctggtcaaccatcttcctctccatcctctcctgagtctgatttgaaaagaaaatggagtttgtttggtctcttgtatggatttttttgatttgttaatactctcatagtatttttgttcattcacatgttgccaaataaaacagagaaagacaaaagtatgtatgtttcacagtgttgtgggcttttactcagaaaaaaggaagtgaggtatgggctcatagagaaagagagagcccaaaattggagaggcgtgttcaagttggccacagaagaaggggagacgtgcgatgcatcctccacgttgctttgcttcgattggttaaaacctcttcaatcatttctgaaacttctacatttcttcacacctgtcctctcctccttacctgtccgttttttgtttattgttctgctttttgatatactgtatcaaagatcgattaattaatttccgaattcaacagctcattcattagttgattagaaaatttagtttggttaagcacataagtaacacgagtcaaatgtcagagttttgtttattgcttaagcaaatactactatttcttaaattgagaaaccccaaacaagagccaatgaaagttttgtatctttttcttaatgacttaaaaaagggaaaaagataaaacagatatcatttgaccacacaaacatatacaacacacccaatcagagatcgatcgccattaacgtagactgtgactctcggctcttcttcactctcaatttcgatcggc

SEQ ID NO: 31 - DNA, 3000 bp, Arabidopsis thaliana
cttgtgaagtcctcagatcagatttcattggtaagtttattctgatttacaacatctctttctactttcttctccaactcaaactaaaagagctctagatctacacattatccgaatgctcttgccttggaaggatcctaaaaatcaaagtactaaagtagtgaatttgggactgaacctctcctcgattttcaaatcctagtggctagtactaaaatcatgttgtatagactgaagttctgttctttagtctacaattttttccaatatgtatcatcgactttctatggtcacacatctttggattaataagtcgaaaggattgctttaagtagataagtatctttagagaaatagtttgacattctttggccttggaaagtcaggggaatcaaaaccaactgtcataggcatataagtccttatttccttgagagtttcattctttcttataccggtttttgctcatgatgagtttgttttttgcagagataagaacgtttgaggtgcttctcagaacatatgaagtgaaggaagtgaaaatggataccagtagcatggttggtgagagccacgaggaggacaatgaaggaatgaggccttgcaagagaaagcaccgttcaaacgaaaacgacactgtttcacaggacaactcttctaatgcttcttcagtcgtcatggctcggccttgtagtgaagcaagaggtcacaccggttacttaacgtttgcaagactccaatgtctagcttagtccaaattctccaactacattatgatattcatgtattagatattttcatgatttgtcttattacgctttctttttgttaaaaaaataattgctgtgaatttgtttctagaatacaaaattcgaaatttggtaatgacaaaaccaaaatccaaaattttgaaatatgataaatagtagtttctagagataaattgttctacaagtaatatataaatagaaacgcgtttccttttctcgatgggagaaggagacatgtaatgcactctataaatatcgaaaacgtctgtttaattttctttctcttacaattgtctattcacaaaccctagagatccattcttcgaaagcctgagatcaaaatccaaattcttttttcctcttcttataattttccctttatccatcaagaaattatgtgtcccttgagatttgtattagtgttcttctcggcggtactcgcaggatatatcgcgtggaggacggtgaattctacgccggaactattctcagacgagttattacaagccgaagccaaggaaaaacaaggactcgatttcaagagaaagatggataatgggttatggacgttcgttgatatggctagcggaagatacctttggagaaatctcaaggagatgcgtcagagaagtcaatgaccgatataaacaaagtttcgcctgtttggcttctgatatgtagaaagttgagaacaagaaaaattgtttcttcgttttcgtaaatcttgtccgaattcatctgaatttggtagtttcattcattctttaatttggtattcatgtacttgaatttcatcgttcgtataaataaagaaaccttattcttcccgccaactctaatatattaatctgaaggtaaacgaacgaactagatgatagagatcatatcaaacccacaaatttaaccataaccaaccttaatacataattacatactaaagagtaaagagttaacaaatcttgtaaaacaagttgataaagccttttacaaagcttaagtcttaagatgtgaatagcttagcttgtggcttaggccattcacatcggtaatgatatgagtagattggaatttctttatacataattttgtttttctaaagtaaaaacatatagaggaaattatggcctactttcagaaggttttggctaaaaaaaagaaaccaaacttatatagagagatagagatttaggacaacaaaaagcaccatataatataagttttcattgttcatatagtcctaaatcctaattagttatgcttttgtttctgcaattctgcttggatatgtttgtataactttcttgtaatttggatgaccaactattgtatctgatttcatatcaatgaatgaatcagatgttaaaaaaaaaaaacttgattcaatctgtatagagtgatttttaagggactacaataacatgggcccaaataaatgtttaagataagctaagagaagattaagcccaataaggaattgagagggccctcgatattatattaaaagaaaagaaatgtagctggaaacgaaccggcacggatttcactccttacttttctccactccagtctctctcttttctgcgtttcctcttctctctgtggcgtagagttatagagaggaatttaggtcttcttctttggtttttcctttgctcttcattctcatactctctcgacagtgaaatcaggttcttgttttttttcgtagacctacatttttcgaatttcgtttttttcttcgtgccgaaatgtcgatatctctctttgtctttgccgtaccattttctgtagttggggattttagctgcattttttattttccttaggttctgggttatatttctctgtttgttagtgtcttctcttgttgtctgaagagtaacgaggtcgaatctgttcttctgcatgttagggtttttgttggcgttgtgtctcaacctgtggtgtaatgagataatcagagacccttttgtgaaaaagtttcgcttttgtcttctttccgtctatatgtttggtgtgtgtttctcgacttaaaaaatccatgctttctggtaaagtgatggtctttgtcattgggttgctttgcttctgttgatagtttcttctggtgttgttttgtttttgttttctgatagtgatgtgaattgcaaagttctgttttttttccctgttgatcgtttaaattttagctattattggtttcgacatgttgttcttccaggaatttggt

SEQ ID NO: 32 - DNA, 3000 bp, Arabidopsis thaliana
agcaacgacctggcctgggacgaagtaaacccttaccagggttgagaagcttactattactaagccttttgccctcccagattcagtcagtaatggcttctatgatagagtaatttagctatagagttttcagctaaatagctctttcgaatacttccgttcgtgcttacctttgtatctatatcttccctcccaatgaaaacgaggagaagaggtcacgtctcagcccaggagaaagagaactactcgactaagaagtcagtgttggaggtgtactaatccctctcttctagccggaaagactttctaaccaattccattaataagctaaagagaagttacagaagtacggaagtgacagagaagtaaaccttcttagccaagggcagcgcagcgcctctgatactgaactagatgccgcaaaagcaccaactctggcatcatatcccgaagatagtcatttcagtctgttgggcagcgttttatagaagtgacggaagccaaccgactgacttgcagctgccagtgtccgcctgactttcttctcttttactatagatgggagtctatattcagcatctaggttactacactgaaagcctaatagtaggtctgcaagcctaattcggattctttttctaacgtcctacctacaggcgcataggagctagttttccaaccgcggaacaatatcttacacttagattccaccatagtgctagattaactaggccttctctccactaaacagattccatcgtagtggatagaagtctttagactaagggcagaccgcaagggcaaatcttaggcattggttccgaggacggtagcctactgagaatgaaggaagagaagcgattttgaagactttctaagatatttccacgatcaataccgacttccttatcttttctcttggaagtcgaacctttatctgtatggaaaagagggcttctacctatacttggttgagaaagggctgaatggtccaggacaagaaaaagccactaaaaagaactgtaggtcatacagggtagtccactttatctttatccgtgactctgagtacaagatttccgggatcaagaaagtcgcaaataaatatgctgggctggactcttttctcgtatgcccggaaaacgttgtttcgatagaactcagcttgctgcatagctcgtctaaacaaaacactccagatccgcacttccctttaaatatactccaaagggactaagcttgactaagaagggctttgctccgcatgagacaaagttatcaaaaagtacttattccaatttagataaccctgattagaaacacacttgaccgttttctagcttgaaccagaacaaacattaaacgcccggaacaactgttagaatttcgatcgaacaagtattggcattctgtcagcatttcccccgcggtcagtgatagttaggaaaggaagaaagaaagggtgatacacgagaagataggtcaggtatatatagcgattgcagatggtgcaccagtttcgtatacataggccctggttggtaaggtgatgagatcgacacattatatgcgatctacgttcataggttctaccttgaagctcttctcctttccttactctaacaagtaagcaaataggaattaccttgtgaagcaacgtaaatttagtgagttttgggaggttagccttaacacatccaaatcttacgaagtcaatgcggtagcagccactgtcccgaccttttctgtcactccttcctttgaaaggagcttctcgccgttaaactcagctctttttccggctttaccgattagatcagtttagaccttaccttgggattggtttttttcctttaaggctgacccttcttatagaaaactggcatctagaaaactggcatccaaaggtcctcaaccagggataaatcgacaaatctaggataaagtccacttgaatcgaccaaaggggaaggaagtatgaaaatccaattctttgacggaaactaaaggctaacctacaagctagcctcgtcgaatcgactcactctcctaacctcaaagggaatctgagaaacaagtagatcaaggattcccatgttgcctatggtgtcttgcgaattcctaggaatgttaggaatgggagaaccagtaatcccagtaatcccaggaataggaggtaaggagattagttggttaggagggaatcccagcaatattagcaatgaggtgatgagattaggtttgttttggttagggattagaggaatgggagaggtaagccaagtaaggtaaggagtttttgtttgtagaaagttccatttcaatctgcctatctgtttgaatcagtttatcccaaggaagtgttttactctttaaattggtagttggttaaggaatcccaggttaggaaattagattagttggttctggaatccctggaatgttagcaatgggaagagttcaccttgctctctctccttttagtcgagtaataaatccctctcgcagaaagctcaagtatgtaaacaacctctccttttagtcgagttactaaagtacctctcgcaacaagtactcgagtcacaaaactaaaggtcgagtcatgacttcgccctcaggtgggaggagaaactgtacaggacatagctttccgcctctttctttcacaaaaaaatgaactaccaaaaactgtagatttattttttgaaaagagttttgtggccttttcaaaaaataaagaagtgctactcaaaatgtggcggagctagatccttacggatcgtggattcagagtggcgctcgctttattaaaaccggaaagactttatcgtagaagcgggacttagaaaagtcctaaaatatctttctgaccatggtgtcaatagcccatactttcagtctttttttaaaaagacaacgtgaagaggaatagatcaacaaaacaaagaaaggacaggaacaggggttgttgcagaattgggttcgagtcccagggacgca

SEQ ID NO: 33 - DNA, 3000 bp, Arabidopsis thaliana
gttggttattatggatggagaatttgttaatccaaaaaagccaagaaaaagaagcaacatgaccaacttccatcattatcaagtggagtgtttttacactgtattagatatgcaaattcaagagtttaatgatcgtttcgataaggtaaacactgaattacttagttgtgttgcttctttaagccgtattgattcgtttcatgagtttgatcagttgaaagttctgagattgtctgagttttatccacaagattttactcatgtcgatcagagatcactcgagcatcaacttggtctttacattgacaatattcgagaagatgaaatgtttgctaatttgaagagtctaggagatcttgcacgcgttatgatcgagacaaggaaatatctttcgcatcctctggtttatcgacttttgaagctagttttgactttacttatagtcactgctactgttgaaagatgcttttctgcaatgaagattgtgaagactacattgcgcaaccgtataggtgatcagtttctaaacgattgtctagtttgttttgttgaaagggaattatttgataaagtgacaaatgagatagtgatcaaaagatttcagagtatggaagaacgtaggataattttatagacttttttttaagaaactatttttatattaatattttttatttaattttatttttaattatattgtgcgcgggattaaaataattcttagatccgccactgcttgttggtatgtttgatacacatctcgttgaatcttaatatactttttagtgatatgagttcataatctcgtactcgtatcataaagcacttcatatgagtgacttaaatatcacagaggaaaacataacattggtgtcccaactcattgatctcaagaagcaatctattagtgtggacattgaaaatttatacgcaaataacaaatacaaactttagaaacaatgtacttatcaccaaaatctataatctactggtttggattaatacaattgagagataagtactaacaacttaaaaacatttttcagtctattataaactaatttgacaacaaagtttttaatctgaaaatacataatttaacttggatttataaaagtcaagtcaaattcactaacaataaatatctttaaaataatttcacttctagggtttagccaaggtcctcgtatatatttggatccgccgaacaaggcatcttcttcgctgctcatttggaaaacgcaagctaccacagatttagagtttatccaccttatctttcgccgagatccaacaatggtaagttcctctatctacatacatctctctaattctactactgctatcacatttccgaaatttgtgggtttgtaattcggctccaatgggactctctaggctgatgtggaaccagaggttgcagcagcaggagttccaaagaagagaacgttcaagaaattcgccttcaaaggagtcgatctcgatgctcttctcgacatgtctaccgatgatcttgtcaagctcttctcttcccgtattcgcagaaggttaggctttttgaactcagtaaaagtttcgtcctttgtagaatcatctcatgtgttttgactaatttgaattctctttgtataggttctctagaggattgacgagaaagcctatggctttgattaagaaactccgcaaggcggtaagatccctaatttctctcgttactaattagaactgttttgaattggtactgttctatgtttgttgaatctgattctacgttgtgagctatgtgttttcctctcattgcatctgtgtgctttacttagaaatgcgtgagaagttttgtgtttgttctatgcaaccaaattggttcaacttctaaagattactgctttgttatgcgtgaccagaaaagagaggcaccagctggtgagaagccagaaccagtgagaacccacttgaggaacatgatcattgtgcctgaaatgattggaagcatcattggtgtgtacaatggaaagactttcaaccaagtggagatcaagcctgagatgattggacattaccttgcagagttctccatctcgtacaagccagttaagcacggtaggcctggcgttggtgctacccactcctccaggttcatccctctcaagtgaagaccatacagagtctgtgttgtgctcttgttttgttagatctcattatgcaattatagggtcctccttctttgtcagttttgggaccattttgtctgtctgtacttctctgtttggctactctgctgcgattctctcttctttagatgagtctaaactcttgttccattcgtttaaagaagactcaaaactttttggaaaatctactatcagcaatggctagttcatactcatatatagatttttatccgttcatgcgttgaaggagatcaagtttactactggtgggcagaggttggataatcgaaattcggctgttccggttacaattcgatctgtgtcatctggaaacctgttgtccccgagggagatcagagcctggagcaagaaccatacatagaaaataatatgtttttgtatgatgcagagttgcaaacaacctttaacacaattagacacactttgaggattacagtagtagagaatgtttgtttgttacaaattgataagaaaactatcgactcgcaggagtttaggtgtgttgttgtttaccaggcaattaaatctggattatgaggtttctctatctaatactcaacggcaaatcccgagattcactcaccaatgaccaaatcccttgagataaagtttgtgcacgtcttattttccaaatatatgggcctcaaagaaaataaaatccaaaatacatgtacctaatagtaaataaatgttactaggtttagcccaagtatatatttgttgcttaagttaagttgtttgtcgtttgcgcagtcactgtttgaggctctgtggtgttttttaggttttcagcaattccaaacaaaca

SEQ ID NO: 34 - DNA, 3000 bp, Arabidopsis thaliana
acagaagaaatggctcggtgaagaagaaatgaagaggaaggtgtgagatatggaaggagctaaaatgggcttaaactaaactattgggcctaaaatcattttagcccattgaatgcgcgttgaacatttgtggtcacgaacactttagctattgaacattaaaaagttttctaggatttgaatcttgcctttgctcaaaatagtttctattttattatgatatacaatattgcttttcccgtaagtttcagccagagtacaactccatatttcactgtctcctccacattacaagaagccttcaattacaagcactctaacatctttattagcctttttcttttgtaaagaaaaagaattatatatctatctgttattctcagttttgttcttcatgaaaactcaattgcatattgtaatatctttcttttttttgttttctgttttgccttcaacttcacacctaacatattttttctaaatctaatccatacatttccctactttatctatacgtatctttgtcttatttatagattgagaaccaaacaatgagaataacattttagctacctatttataatacaccaactcaagaaaattgttgtattaccaattcaatataaacatgttaacctacaagaccttttagccccacttggtattctttttttactatatgtttttcctttctatgaaccaacttaatatatttcatacaaaattagtttctgattcaaattttgccctactaagtctctaaataagtttagaatatgtttaatcagggatagtgtggttgactgagagggcatttttgtcattatacatcggtaacaagtcttgataggctcttaaggccagtcttgggttatataacaaggcatctcccttttggtgctcatgtaaattgaggaagagaaaaaggatctgaggaacaatggctacgacaagacagatcttggagcagccacaatcgccatttattcaacgtatcaagagctcggggaacattagcatgaatggcagtcctatgattgatgagaaagaagaggagctttcacagtctgcttttgctttgtttaaggcaaaggaagatgagattgagaggaggaagatggaggttaaggatagggtccagaaaaagcttggactcgctgaggaagctactagaagattagccgagattcgggaagtaagtttggtttgtaacattttcaagaacttgaacaaagattttcattttgagagagttttggtttgtacattttcaggagcttgaagctcttaccgatccaatgagaaaagagatatccgcgataaggaaaagagtcgatgctattaaccgagaactcaagcctttaggacagagttgtcagagaaaggtaaactaatgtttgtgttaatgttcataactctttatctttcttgcacattcttgagaccattggttgttgttgttgtcacaggagagagaattcaaagaagcacttgaagcttacaatgaaaagaacaaagagaaagctatatttgttagcaagctagttgaggtgaaacattctgtttccatttgtaattttctttacaaaatgattattgttttctgaaatcttttggtatgaaaatgtgtttcttcagctggtcaccgaaagcgagaaactgcggatgacaaagctggaggaactcagcaaaagcattgaaatatcgctacgctaacacaaaatgataacaataaaggctgcaaaagcagccagctttggtttcttctttcttctgctctttgtaattgtttgattcgatatttgctttttggtgtgatcaaatctgttttcctgattcagtaaccttagtagaaatgtgataaagattcagtatgatctcacatttttttgttttcatgtgtgtgacaatgttttattcctgacccttcgagttttgtaaccggaaactttaacttctatcaaaatttcttacaaaagctttcctaatccagtgtatagtgaaacagagaaacatactcaaataggttaaagaactcagtgaatagatgaaactattaataaccaggacgcaagagttttttctctcttttagcaatcttcctcatcttcttctgttgaatcctatcaataacattctctgatctcttttgctgtttctctgccctaaacttctgttgcacgtcaactctttccttccacttctccgtgttcttctcacgcatcttcgtttccttgtgaattctcttcttcaatcgctttggatcatcatgaatcttgataccagcagctctgcttatagccgcttgccacgagtgatttttcgcaacaatatcccctttctcttgatctttcttcaaagcctctaacgtcatcgccatttcaagctctttagccttagaaaccctctttttctttctgtgtttcccgtatatctcgtcaccgtccccaatcttcatataaccataagtaagatccttcacaacctcttcaaaaacattcaaacctgagtctctcttcctcttattcttctgaagacggctttgtctcatcttctcaaatgtatcatcttcttgcaaactaagaaacttaggcttcttcatgatatccgattcaagatcaagtttctcctttttttttgtcttctacaaatataatttaaaaaacagtcacaatcagaacattttcgtttgcttgtgtagtcaagtgtagaagccaagaagacacaagagttgcagaaaaaccctaaacctaaagctttgagcaccaccaaaaggcaaaaaacaagaggaaataaatttatagcgaataacacgtattgggctaagttttcattgggcctttcaaataatagatgtcaagtatcggttagaaaaccaaaaccaaagtgaattgaaaacgatttagttataaaccggacctatttttgttctctgtttactccggttaaaattgataaatcggtgcggcgaagagagagagagagagagagacgaaggcg

SEQ ID NO: 35 - DNA, 3000 bp, Arabidopsis thaliana
aaagatatagacagataaaaattaccaaactaatccaaaattctatattcatataaatattccaagtccaacaaggaaaaatcataatagtataaattaatcccttagtatttatcttagcatcatcatcgccgtcatcgtcactttgtctcgtccaccttttaaaaaccctctctaaagtctccgaaacatcttctctcttaaacaaatcctctctgattcgatgggttttagcaaagaagagattagtaaaaccagaaagctttggtcatctctatggagaggaatcaaaactatattcgttttgttcacaatgttcttctcttttctccttgtctctgctcctatcttcctcgccgtcgccgatgctctcctcccttccgctctcctccaccgcttctcttcgccggcgactctctcttctcatctcaccaactacgatttccgtcactccctcatcgatattcctttaatctcaatcattagatccgctgttatactctgtgagtaaaaaaaagattcaaactttacaaaacccaaaaaaaaaacagagcaattgctctgtttgctctgtttctgaagaaatcgaaaactcatttctttagtttgatttttcgtgtaaacaggtgtttatggactctgtgacggaccaaaactatcgagaggaccgtatctgacaataacaatgatttgttcaatatcttctctaatctacgtttcgttaaaagctgcgtttgtgttcggtgagccagcgatcggagacggaggaggaaactacttcagagcggcggaagtggctctgtttctatgctcgtcagtcttagccataggtcacatcgttgtggcttatcgaacaagttgtagagaaagaaaaaagcttctcgtcttcaaaatcgacattgaagccgtaagtccacttctccatcttctttttttccgccgttacagaaatttattattttattatatttgattgataatcgatgtagggccaataataccaagttgcatttactttttttcaaatctaggaatgaattagatttttaacctgcaatgggtcagagtcagagatagcatgtgaatgtatattagtcaatgttgaatattaaacacatttttacacatttggtccttttgtgattctagaaactcgatgagatttgtctttccgatatgtttggttaggaaaagactctacttggtgagaaggttttcaaatgaaactaagagaaaacaaaattgaagtttggattggaaaactttcttatagagttatagttttgttttgtaggttagaatttcatgtggaaaccgtgtggcatgtaacctaattttcttagtcattttataataagataatatccgacatgacacgtcacacctcacgcatgcatgcttcatgattgttttcatggaggcaaaaccatcaaacctctttcttcgttatagttattatcaccaatgggaaaactaatgtgttttgattgatccatttttcaggtttcggcttgtaaaaacgtgtacccgagataccaaaagatcttattacaacaagagagactcaaatagagacgtatttccaagagaatcaatacttgtaaatatatacacatacctcaacatgtaaataaaactaatatataaaaacatacggcgtataaatgtaacttctccttctgcctttcggcgttgacccatcaactccttcgcttttaagtttcaggtaaaccaacctaatctcatcctcttccaatgttcttgcttacgtatttgttattcttcttctttttttgaatagaaatgatttctataatattattaattgggaagtgacattatggacgttacaaagttgagaacccttttgctgataatgtttgtttatttgtcttttttttttctttaacagaaggatccaaagcaaaaggaatggagattaattatataacctatgcttttttaaatgagacatttcagatgaactggcagttgttagctttaacattatattagttagggcgatttgtaaataatccagagttcctcaatgagaaaagaagcccaaggctgtctctccgttttgtatatatgtttatgtttgtatttctttgtggttttaatatatgttttgtaattgtaatttgtaagcataagcacatagtatgtgatacgtccgcgtggatttctttatacgtcaccaaaatctctaatagaatcgtaaagcaacctttttacgatcattatctatttatcttaacttacattctagatatttgcattaatcaaagatatctcaatctatttaacaatcttataagagagtctttgtctattgcaaactctaacttcctatcttttcgtgtaaataacttaagactgtgaggatgtctaaacaaaccttaccaagtatagggagaaatagacaccaattcggtttgatttactcaaaccaaacaccaatttgaaagctgagaggcattttagttccagttatatgataaagtactaaacacaaaccaaaaccaaagtattggcctaaaatataccaagccaaagttgtagaccaaactaaatgctggacttactactagacaatatcggaaacacgatttaagaggcattttgtagtcgattaatgggcttctataaatgggctttagggggacagaacttcaactgggaccaaaatattttctcttttgtgaaatcgacaaaagaaatccttaaaaacgaaagaaaacaaaagaaagaaaataccttaaatgcagacacctaccataaggacgaaagagagagtgcaacgtcattagaaagtagccaggccacaaaagaaaaaaggtaaagagagagaccaatcacaggagataacgctaagataaggcttcttacatttaccatcacatataacataacgttactattattctaaaatccaaaaaaactatatgttataacattggaatcatcagtctctaagcagtatcacaccaactcaat

SEQ ID NO: 36 - DNA, 3000 bp, Arabidopsis thaliana
tacctagaaaaaatataaaacaatgtcaaaaacgaaaaaaatctgacaaataaaattaaaattagaaaaccgacattattgtataatggtttgtgctagtaattttgttatgttgctattcggattcaaactcttgtatgttattgacaaataaaaaaatccgacaatcatgtatttttctaagttttgaaagaattaacttattttaaatttctatattggattattaataaaataaaggactgagtagataatgtcaaaaaaaaaaaatgagtagattaataaataaatgagagggaaaaaaaaggcgagattggcggtggtagatgtaggagaagaagagaacaaaacaaggaggatacagttggctatggaatattatggttcataatgcaaccaaacacatataattgaaatgaaccacacacacgcttttaattatacacataagagtgatcgagcaccattacattttctttctttgcttcgttgtaaagccgactttatattatcatctctttttatgtaaaagaaagttgtaatgggttttaataatatatataaacagaatgggtcaatctaataaatattcggaccacaatgttaaaaattagttatctgtttttttccggccggaaacaattatggtgatttaaaagattatcatcatcaatttttattttttttgacgttatcatcaccaattattgattggtatatattcttctacggtttctgtaaatttatcatgaaattccttactatgcttttttttggttaaagaattatttactgtttttgataggaggaaaaatgatcgtccacgttcagtatacggcatcatcagcaaaaccattcaaaaatgtttttactggaacggccaaatatggtataacgacttatagcattgtgtacgtgtgttatacaataacaagttctctaaatgtttcgaagtttacatggtataagagcctctatgaaatggaaacctaattcgttatcatggagctcgtccaatggtgagaaagaactcagcaccaagttggtggaattatcaacatcataagagagttcttctagctctttggtgcaagtgacatgtgagaattacaaaaaatgggttaagaattaaaaatgcactcaaattattggtttgttagaatgaaagtggatcacaaatagaatgtggtcgtggagctagaaactggagggtagaggctcatatcagaactcacctcaaagtccatatccgtgtcaaggcaggcgtggacgaggacatcaattaaggccgtagtactgtcccgtattaaacacaataataaaatcgtaccttgaaagctataagaaaatagaagagagtgaacaatcgacaaatgacaacgagaaacatttaatgaaatgaaaatatctatgctccagacacagagataacccacgggcagccaatgaagcactccacttgcgaatttgtaatagaccctacttgacaatgagtagaagagccatatcatgtatatttaatatttaagttggtgtgttgtagaatacgtagaattgttttgtgccataaaaattaagaaagtgtttattttgttttcttagctcgtgtataatcaaatttaagtagttgaattcgtggaattgtagtaagtaactgtgtgcttcgactaagtgtatggtgtgatggtgtcgtggtgacatttcttcggttcttccaaaggaagttaaaccttgcactgcccgcttgatcccgtttgagagaaatgagtccaataattaaagatatcataaatttcttaagttaaaaacagtgtgttgaccgatgaaatattatacaaaaatgtcttttctacctaattgagagtcacacatctttgatccaatttttctctattacatctttgatacaatttattacatctttgatccaaattgcactctattacatctttgatccaatttttctctctatttttctaccgattacacaataacatattaatttgtccataaagattgttatgaatggttcagtgttacaaaatctccattattccaccttgcatattgctgcggaatgcccaagaaacaagactaaagaggcgaataaatcacagaagcgaaaacgctctaaaattcctaatctaatagacgcattcgcctctttgatttattcgccacaaacaagttttgttagtataacaaataaaaattttcccttcgcagaaacaaagtcgagattcgacaaaacgttcaccattcgaacaccaacaacgacgaaaagaagctaattaataaaccaaacagaagagaaagccttggcctgcaaataaccgtcatgacttagtgctggctgcaactaacgccatgaatggtctatcaattaagaactcttttgatgtaattcactacaaaatctaaatttttgacccgctacaagatttaattgggagatacgttgaatctcaaaaaaaatcgtaagaaactacaatcttccttcctataggcatgaagcttgttgtatgcttcgccaacgttacgtgtatgacttataatgccacgtgacactctcttagttggcggtttttgtctaaatcttttatgtgacgtggtgcgttctgatattcttattggtcaattatttttgctgatgtggtatgagaaaagtcaaaatcgtttcaaggagatttgttatcttagctaaaacaaaaagaagttattacaggaatagaaagagagagagacgaaaatttacgctgatgacgtggtaagggaacgacggagtggggaaccacaagccgttcttgatattcaacgtggtttgctcatggcggcgcgtggtagactcgtggtggcgcgtgggaacagaagcttttcatctataatcagaaaatactcattgaaaagtccatttccctctattttgttctttcttatttcttgcaatttcatctctctcatttttttttctgataaaggtgcaatctcatctcttgcaat

SEQ ID NO: 37 - DNA, 3000 bp, Arabidopsis thaliana
tatccaacaaaaaaataaacatttcttgcatgaaaactaatattttccagaaaaaactaaattcgattttccagtactaacaacaagttctttttttttccgggaatttataggaaattggatgcataacagaaacaggatcaaagataaaagaaattatgaatgaagaattctctgcagaattgaagaagagaggactttgtgtagttcctttatccatgttatctaactttattgcttgatgattcttttattttactctctaagttttaactgttattattattttttattcttctgattctttgatgtaaaattgttactatgattgattgacaagtaaaatgtatagaaaatcgaattcttattgagagttaaacactttgcttttgtttgtcagactcgttggaatgttagaaacgtgagagcttaaccttaaagcttatgacaaagattctccagaccgttttttattacagttttgctatatacactacttactatggtctgcacctcaaaatacagagagcttaagagatgataaacagagacgagtttcggtctctcggggtctcatttcttttctggaagcttctccagcaactccggtatcacctcgaaaagatctccaacgagtccataatcagctacctacagtttcatagccaaacgttttttagaatactttggtcctaacttaaattgacagagaagaaccgtgtcaagtgtgtttgttacctggaaaataggtgcatcggcgtctttattaaccgcaacaatcaccttagaatccttaattccagctaagtgttgaatggctcctgaaacaccaaatgccatgtatagctctggtgctactattttacctgtttgccccacctaaagatgcaaacaaacaaactcttatttgagttttaaagccgtaaaatggaaggaataatcaagcgaagatccaccaaatcttacctgaagatcattaggaacatatccagcatcaacagcagcacgagtagcgcccactgtataaatgaaacagttatacacgtacatttcgaagcacattcacttgagagataaaacaatttctccacactcactggtgattaggataagcatgtataactaacctgctccaccaagtttttctgcaagcttttcgatcattttaaaattctcaacactcttcaacgcccttccaccagtgatcacaacacgtgcacttccaagatcaggccgttctgtatcctgagttgaacgtcccacatatctagatttgctgacagagtctgcagtgaagaatagcaaaaccattcacaaaaaagaaccaccgacgaaaacacgaatacataagagaaacactaaacggaccgtcttcaaaatttgagagatcaatctgagagacagtagctttctttgactctgagtttgctgtaatcggggtgacaggaaaagatgtagatctaatagtcaacatacaaggacccgcaccagtataacgaactgtacacaaagcgtttcccgcataaataggcctgacacagataaaaatcttggtttcagttcacagttcaacgagaacgagagagagttggaatgtacctgataaactggtcagatcctaagattttgacaacatcagtaataggagaaacatctaaaagagcagcgacacggggtaatatattcttgccaaatgaactagaggaagcaagaatgtgtgagtaatctccttgttgccgaacaaagtcaaccaatttagcccaaggctcagctaaagagtactcaaatttatcagaatcagcaacaagtacctacagaaaaagtaccaacactgagaccacaaaaccaaaagaaagcaaatgaagagaagggagaatgttgtagcttacctcggaaacagaaggatgacaagaggcagcttgagaagcagcttcttgaagagaagaaccagaaccagccaataacaaagaaattgaagagctctcacctaatgaattagctgcaactactgtactcactgtctgaggtttgattgtaccactctcatgttctgctagaatcagagtgctaatctatatacaacaacaaaaatgtacacaacacaaaagtgttattgtgaatttctcagcataacaacaacaaaatgattatctcaatatatatatatatatagaagcttcacaaattgaaaattttcaaaccaagtagaatgataaaattgaaatcaccaccacaaagaatgctcctttaccacttccgattcatttttaatatgaaaaaatcgaatttggtcacgacgaaaatgaatgatcgattccagcaaaaacaaaagatcgaactgaaggaaaatgggtaggagataaaagatcatacgcatctagagagactggtgatggaaatggatatagatcgaggagcattagaggcgacgaacttattcttcgtcagagctctcagtagaacagttctcgtcatcgttttctcttctgattggtttctctctccttcagatttcagaattctcgcaaaaagaaagaaataagcgaactatggcaaacgtcgtcgtttataacaatttcttattgctataggaactacgtcgtttatgataaagctaattgtatcatttttaaaggaattaataattgtttgaactttaaggatggtcaaagatcgaagctgattacttcatttccatttgtagtagattagattcgacagatttcacaacttccatattctaattttctaatttttatggtacgatgatgattcctgaaagagaacaaaataaaaatctaacctttaaaggattagaattcttcctgccaaaaaaaaatctgtctttttgagctttttcgtgtagagttcccatagttaagcaaagtgggatcacgacggctttaagaacaaaatcctagatacagagatagagaaagagagctcattgtcaagatctgtttttttctttgttagaatcctttcttctttgttacagcc

SEQ ID NO: 38 - DNA, 3000 bp, Arabidopsis thaliana
gccgaggcggtccatccagacgagcttgatgaagagtttgatacgtttccaaccactagaaaccctgacatggtgcgtttaaggtatgaccggcttagaagcgtggccgggaggattcagaccgtgatcggagatcttgcaacacaaggagaacgttttcaagcacttttaagctggagagatccacgcgctaccgcgatatttgttatattgtgctttattgcggccatagttttcttcataacaccgattcagattgttgtagcattggctggattcttcacgatgaggcatccgaggttccgacatcggcttccttctgttccagttaacttctttcgccggttgcctgctcgaacggatagtatgctctagcttatattggctggagtattttatgtgattgtcggatatagacttatgttactatttgtaatctggatttgttttatctacaatttttttttcatttgaaaacgttataatattttggatggtattcattagtgtttccttttcaaaaatacctctaagaaaatcagagaaaggatcagtgagtccaaaattcccaatttggtataaactagaaatgaaatttcttttagattcaattttttttttctttttgtgagcttctagattctgttagctagagaactctgaatccaaaagattcacactcacaaaaaaaaacaagaaaggaaatcactctttctttctcttaaaataaagatatcccttctctctacaaaaatctctaccgccgccgtttagggttactggttccgttggctttttcagcaccaaccgagttttctttgttttagtctctctagtttcgatttcttttgggtttgatgtgatttgaatcctgcttttcttccaacggtttcagatctaaattctcagatctagatttataaagtctaaatccttcttctaccggatttgctgcttgttttgtctccttcatctgcagtttcagttctggtcgttccaaccatgacagagacagttctttctgatccttcaatgcctcagatgcatatttctcaatattgaagctcttggtctccttcctttcttcatgagactttttcctttgaatctcgggagtgttgattgatgtctcactgccgttggtggtaaggaaagtcttagttttatttcctttggatagatctctagtcttagatctgtttttaatttaacttggatttatactttgtactttgtttttgagttcttttagtaatgagtttgagaagtttagatttagtatcaatgtttttctttatttttgagtttttttttcattttcgatatgtttttattcccgagagatattgtttgctcgccggcttaattttgggaaggattgttttccttgccgacatatgtgttaaaaataaaataaatacaaaaataccctttaaaaaaaattccagcaattttataaaagtctatcgtttaattacggcagatttattcttattccgcagacttttttaactgcgacagattttctatggcagactcttttggttgacagactttttagaagatagtgatgacagatttataaattatagctgatttaatttgattgacagatttttattttattcaaccacaaacttttatataattttatagacttatttttttgtcgttgtattttcacggtaagtgatggcagatttatgattttgttaaacaaatctgtcacattgtaacagatttgttgtcaaaaaattaattactagaatgacgtctaacgataaccaattttttttaatgttatgacagacttgttttaagttataacagatttatgtaatcttacacaatatctgtcgtttgttggcagatttattttctaaaatatgatgttttgtgttatgacagagttgttttatgttgtgacagataaatttatattaccataaatctatcgtttgatggcaggtttaataaataagaaaataaattgctgaaatgaccttaaaaatattttatgttacgacagatttgtaattaggaattcttatggtgactgatttttagttttcttgttccataattttttgtagtagaataatactaactgttgtgacagtttttttttcattttagcttgttatgactgatttactaaaattagttacaatatttaactcataaaaaatattaatatcgagatacaactagggttttggttacaaaaacttagtctccttacaaaaaatatgtggcctcctttctttcttttgtttatctttttttttcctttggaaatctcttttcagtttttggagtagtggaagcaatatattgtttcatctcttttcctcgtatgtgtgtgggttaaaaaaatatgaaacctataaactcagaattttgagcgatatttttttaaatttttccttacttatttgtttttattttatttttaatttcattttacattatttttttaatatcagatgttaaaaatttcaaaaaaaatacagaccaaggttttttggtcattatacaccaaaattgtgtcaatctaattctctaatcaaatagagagtcattctagttattattggctatatttgtgtcaatctaggtaattttgacaaaaaaaaaaaagaaaaaaaaaaaaagagaactccaaatccagattgtgaagcatatttcaatttcgcacttattcgatcataaaagaatttacataattcgttcataaaatgtatgggctaaatttaggcccagtatgagaaaaaatccaaaaggcagtagtaacgttcacattatgccgccacaaaaaacgcaactgatgacgtaagcacaccgagtgttccgacgattctccaacgtggctttctcttaaacatccacgtgtctattccattctccaaccactgaacacggatcaagaaactaaaatgatattttgactccaaccaaaataaatatctaattttgtgagaaaagaatcttcttttgcaa

SEQ ID NO: 39 - DNA, 3000 bp, Arabidopsis thaliana
aattgattctgtgccacacccactgtgatttctcttatgcattctatgaattagagcttgtggatacagatttggtaatcagggaacccttttgtttagttgtgttcaatgtctggttattgatttccgggtgaaatccaaattgtctcataggtgcatttccctttttatacaaatatactgatgcatctgaaatctgaactagtagtatgtgcttttgatatgctttgttagacacaagaaccgatcatgaaccatagattgacccataccaagcaatcggcatttgtttactaaatgatcgattagcgtagaatagagtaatcaatcgtccttgaggttctagataattgagtttaagcgtggggtacatcctaagttgctttagatagattagggaaagaatactgatgatcatgtatttgcttctccatgaaccttgttgtgaaacacttcttttcttttcttttctttggctttcacatattctgagttctcgtagttggcttttaaaatgtttgaacttcggccactcttactttcgaaatgtatggacttgaagtagagattgagattgatgtccagtatcttagtgggaggagatacatagccatacttagctgagcagtgatcaaaggtgattttgatttacaaattataatatctggttgtttttggaacatgaacaatatgttagcatctatgtattaagttaacgaaataggaatattcctagcccacaaatctggctttgcaatctacccttagggtatatgattgggtggccctgattagaggaatattattagagtaaagaacaggttattctaactctgtgtcttaccagttgaagcagtagaaaattagttcatttaatttacgcaggaataaggaaagagaagaagcaaagtagaggaaaacattctacttgctctttggtgaagaaaacgtatagattcctccgtatttccatttttctccccaattagttacacatcttgatatgttttttcaaagcgatcatgtgctaaggggccttagaaacggtccataaatacataaaataaagttcatttatcaatcatggcccaaaagtctttgaatctgttcaacgtagttcgacacgtatcgttagattcgttacacagagattctcgatggcctcgttgttcgtgccatctgtttccacccaccacgtaaacaagtatttaaactccgtccatttcttcactctttccacgtgtcgtcatcttgttccatcattcccaaaatatcttatctctgacataaaaaaataccctacttattatataaagaccgcaaaaccagaacccatgttcatgggcgtgacatgttatttgacaaacagagctcattagataatgttttaaattcgaatatccattgcgtaaacattgtaaataaactttaataacgggccgactatataaacacattcattaaaataattatagtcgtataaatgccactgttctctcaactcttaatcaattagaagccgcttagaagaaaaaatgcactatcaagaacagatggagtctcttatgttgggtgaagaacgcagacgcggaaactacaccagagacgtagacgcggacgcagatgaaggtgttaactctccctcttcttttccaaactcccctgatgattcggaccgtcgcagttcttcttcttcttcaaggtaatgagaatcagaaagttccgcttttaacccctggctttagtaattgtcagaacaaaccccaatcattagggtgtattcttaaacaatcttatagtttaggggtataattaatttctgagatctttttcgttgtaaagaaactttttaatcttcctaccacgaatttatgtttgggaaattttgataacaggagaggattgtcgaaacattacaaaggtaaatcacaatcgttcacaacgttggcagaagcgctaactgtggaagatctcgcgaagcctgagaatccattcaacgcaaagctgaagcagcgacgagagagccctcactgtcgtagattatcaggatgcggcggcgcatcggagcgaaatttaagtgtccacgacgtttttctcgctgggaacgatagaccgccgcgactttccggtaacagaccgcctccgagagcccagacgctctcggcggctcatatttcggctttgctcactcgaacctaaaccggaagagaaccgggtttcgtttgggacgatgtttttcaaatcttttgttttctaatcttgtacaagttgttgttactttaaagtgttttgactcttttgataattttgtaagtttcagtttaatttagagagcacttaacagtatatatacaagtaactgaccaattgaaaatgttctgtatttttagatgtgatgaactaagaaaattaaaataatgttctgtatttttagatgtgatgaactaagaaaattaaaattgatgaattaagaaaatgaaaaatctaaattcttagagattgatgggctggactagaggagtcgcagttatctatattgggcctacaatgggctttcttaatttacagcctcttttttttgcggcaaatttacatgtctcttagctttcatatttacaaattttacccacttatactaactagtacaaattccatcatgtattttctttgtcattaaaatacaccttactttttgttttatccaattcatggcagaaattatatgtagaatgctaaagtctagaaatgttttggggtgtattccgaaataattaatagttaggtggttcttttgaaatttcttaatgattattgtataatgctgtcaagatgacgtggagacccatgggatgacgaagttttcactggcacgatccattcttcatcgattcaaactcttggattgatttcagagatcaaaagataacactttctcagatcttaaatttgtttgaattcctgctcttaaaggtttttgattgtgcaattttttcggtaaca

SEQ ID NO: 40 - DNA, 3000 bp, Arabidopsis thaliana
atataattatttttcaaacgacaaccgaaaacaagagaattttttcaaactgaaccaaacccgaatggaactacaaatggtttttttttttttttggatatagtttctgtaaaaacataaaacctaatggatcataccgaaaccaaaattgtaatctgaggttttatacaacttgtctgatttatggtgaacagtggtgatcacgacatcgcggtcccttttcttgcaactcaagcctggataagatctctcaattactcccccattcataactggaggccatggatgataaacaatcaaatcgctgggtaatatatatctatttttcctgttttatatatgtctctcttgtttattcatatttgtagtcatatcacaaacttatgaactcacgtaaaaatcattttttttttacagatacacgagagcttattccaataagatgacatttgctactatcaaagcaagtgttattatttcagtttaaacatttttttgtgtcactacattacaatgaaagtgtgtttattaatttttttttttttactgtttggattatagggaggtggacacacggcagagtatagaccaaacgagacctttatcatgttccaaaggtggatcagtggccaacccctgtaacaaaaggcttatgaccttcacctataattatctaccaactaatatccacgttaagcgcagttgtttgtgttgaaatgtttttgttgtttgctttgttgcattcttttgtgctttatgttacaattttatgtgttttatgtactacagttcattattgtgcgttgtgcaattccttttacatttaactagggactaacccgggctagccccggtatatttcctaactatacgtgcaagaaaatgatgttctatttaacatttcagtttaacttatatggtacaagtaattgtttaattttatctatccaaatatttttcattgtaaatttttttttcaatacatctttttaattattaatgtgtatagtattttctcaattatacttctctcgtaatttgttttacgatgttaattgaacatcgttctataataacgaatttgccacactttttttggtattgacaaaatttcctcaaatagcttggtattgacatttgccccacatcttttataatttacgaatatgccccacgtcttttcatattaacgattttgctacatatctgttggtcttaacgattttgccccacatttattggtattaatgaatttccctcacagcttttggtatttgcaaatttgttcccatcttttcgtatttgcaaatatgtcccacacttttcgaatttacaaagttacccaacatctgctggtattttgcaaatgctttcgtcatttccagttatcgaattaggctattgatgttgattcattctatctgaaattgagtttaaaatattcttctttttcacctaaattaaaaaaaaaaaaaaaaaaaaacttatagcaggttgaacctagagatttgatgttatgaaaccaccaattcttaaattaaatatagagatctttttccatagttgaacttgccctaccaaaaaagaggaagaagattttgaattgtttatcctttatagaatcaatgtttgaactcgaaaaaattgaatgatatgtcaagttcttgtctgacattaactacaacactctcattgtgttgactaaagcttgaagatagcttgagtaacaagctaaaggatttgtatttaggaagtttgcctaaatgcttttatgtgtattttcctaataggtttaggaagttttcttgttattctcttatataaggagataccaatgtgtggtataacttatgagtttgagaaagagagattgagaactttagggggtgttatgggtttattgatttgtaaggaattggaaatccaaacaaaaatcatttgttattcaatgattgattttaaaattcgaattaaaatcatgtgttattgattcgatgatttataaatactagttaaaatcctttgttattcgtttagtcatttgtttttggatttgagaatacaaattatgttttaaatagaattaaatggatttgaaagagaaaaatagaaggattcaaatccatgggtaaacacatgttatttcaaaatccatatatcttgatttcataattaatagagattatcaaattctatatagatttacaaatcaataaaccaataacacccttagttttcagttattttttaaagctagtaataaagagagttattctttgttaatcttgtgttcttaatcttagcttagtcaatacattgcacctccattgttaatggtcttaagaaataatgaagccactttatttaactaaattaaaatgaccagttatataactgattgtttcgttaatttaatttcgacgcaaattcagatgcatttttttatggagtagatgaatttcaaagatttattatgggagcaaaaatctaggtttaaagtggaagtatataaaccactttgaacgttttaatcatattttccttttttacaacctcaacaaatcgtcttgtcaaaagaatgcagaataaattagttttttttttttttgtttgggcagcggaaaactttggaccgaatgagggttaacaacaaaagaaaaacgagagcgttagcttgtccatgattgatcaatggtgttggtgattcgctctaattttagccacaaaagcaatgtccctacattactaaatttgtggcaagtgtaatgatagatatatcatataaaattataaaccaatgtaaaaacaaacgattaaatacttgatgtgatggttgctgcaccaaccacgtgactccccgaaatggttgttccacacaagcaaatttgaagagagcctactcaacgttaagcgacttgtaaaaataacaaaagggcagtctaactttccttttctaatgattataaatatcctttttccgtaaaaagaaattaaaagaaa

SEQ ID NO: 41 - DNA, 3000 bp, Arabidopsis thaliana
cattcatcaagcatgttgcaagagggctttgaaattgagtttgaaaagcaaagttccatttgctctattaacaaaataaagcccattattaaaaccaacagattactataaggcccaatatcaacttcctaaactaagcgggtgaagattttgttagccattagtggtaatttctgatcccattgctgctcctctctccggagatacaaaggcgaatctgaccagtaagaaagatggcagtcgagatggcctctcagtctcaggtctctttcttgcgtctttaatccgaatctacgacgatcaattcttcgctctctgaattaataatatgatcacaggttttggtggaagagaaatcgagtgttagaatcttgacactaaacagaccaaagcagctgaatgctctgtccttccacatggtatcgaatatttcccttcttgtacatgcgtactgtattggcttagactcatttttttctgtagatctctcgattgctgcaactgttccttgcatttgaggaggaccctagtgtgaaacttgtcatcctaaaggtaatcattatccttatctcttccgcttacacacatttagtactgaataactttgccacagggtcatgggagagccttttgtgctggtggcgatgttgcagctgttgttcgtgacatcaatcaaggtttaccacccattcttttctgtttcttactttcagcttttatacactctttctctatcttcgttcgttgactaggtaactggagactcggtgccaattacttctcatctgaatacatgctcaactatgttatggccacatatagcaaagctcaggtctcgctataatttcgttttgtttttgtaaaatcactcccgagtggataaactcatcaattcgtataggtttcaatcttgaatggtatcgtcatgggaggcggagctggtgtatccgtccatggtcgatttcgtattgcaactgagaacacggtaatctttccttaaacatgtccatggatgacaaataggtcgctccaaaatatgctcatatctttcgactttctccaaggtttttgccatgcctgagacagctctggggctctttccagatgtaggcgcctcctacttcttgtcaaggctccctggtttttttggtaacagaagctatatttcctttttttgcatcttcttaaagccaccaaagtttgaaaatgctttcttgtcttttttgttcaggggagtatgttggcctcacaggagctagattagatggtgctgaaatgcttgcttgtggccttgcaactcattttgtgccttcaacggtatgaacttcctttgcgtgcgtctatttcgtaagacattctgaattgactttacacatcagatattgtatagctactagtgtcaagcactatctgcttcaccaaggattgctacttagttaggtttactcctttccacagaggttgactgcattagaagcagatctttgcagaattaattcaaatgatccaacttttgcctcaacaattctcgatgcatacacccagcatccgcgcctgaaacagcagagtgcttaccgcaggcaagtctatatgatttttatctcttttactctttctactagtatggttttacctgattacattttctcggttattgaccatgattataacacattttttctataatttcaatttcgtattgctgtcaggttttcaatcgctctttacagaactcatttctcatctgatctttaattgaaaatttataaaagtgcagaggacagttattttttatctccccgtttgttgcgcaggttagatgttattgataggtgtttctcaaggagaacagtcgaagaaattatatctgcacttgtaagcttttcatttatatatagagatgttgacttgcgatcctgagttgactgatttacctttgacaacgcactctaccatcatatgtgttgcttaggagagagaggccactcaagaagcagatggttggatctcagctaccattcaagcattgaagaagggttcaccagcaagccttaaaatctctcttagatcggttagttcccagaatgtgcatcacaggcaatgttgacaaagagctgactgtgagtatatatttcagataagggaagggcgattgcagggggtggggcagtgtcttatccgcgagtatagaatggtgtgtcatgtgatgaagggagaaatcagcaaagattttgtggaggttttgcaagctttttccatctgaaaccgtctttgttgtagaccgtagttacaacagcgtgtctttacttatgcaggggtgcagagccatattggtagacaaagataagaacccaaaggtttaacaagtctctccatttgttatttgtggttggtaatatgtgacattgttgataacaatatctgaaattatagtgggagccaaggcgactggaggacatgaaggatagcatggtggagcagtacttcgagagagtggaacgggaggatgatctaaagcttccgccaaggaataacttgcctgctttagggatcgcaaagctgtgaagtggagaaggtgatggagcactattgtttacgtctgtgggaaagaaaaaagaaaataaatgtaacaacacttgtgttgaataggacttgcatacattacataaatcattattgtatttgagaattgacaccaaagcagcagagcagaattgtgttaagatttgttaatggtgttggaggcacaaccatggcaaacggacgtggaagcacgtctatagtcattgttcatttatttgattgagattcctccttggtctcatcttctgaaaacgaaaaataattagaaaatcaggtgaatcgtgaagtattgaatgagaagaggcaattaaaaatctcccgtgactctcgtctccccatctctctctctccctctgcccaaatttctggggcaaatttgttcatcagatctactacaatctctctttttcttcgggt

SEQ ID NO: 42 - DNA, 3000 bp, Arabidopsis thaliana
atgttaggaaagaagagatggatatatgatgatgattctgaaccaattctcaatagtttataatggaacagaagcaccagtgattgatgatctaacagacattgacatcaggctaccaatgctagtctttctttgggagatagtagcggcctggttatgagaatgttggagccatcaattgctttggttaggaccagagcaatcatgtcattcatcctcaatctacaactccacggcgatgaagtgtcaatagaatcttctatcggacacaaatgatctaattattcaaaccacaacattgtcttctttgatgttaatatataagtcttgcatcttatttagagtgtttgtgtttggttccggttgatctgtgtaactgtctttatgtaatcacacaagtgtatgctgtctggttagtcggagacagagtaagaagacatcctacacatgacattggagaattataaggtaaaatcttgaaccatagatttctaaagacttttgagaaccaaagtaaggattgtattgaacattacaagtttcattggggaatttccacaaacaccttagctgcaaataaaagcattaactaaccaacctacaagacattccaaagcagcaaagatcgaaacttacataaacccaaatccgtaaatcgaaaaacccatgaaatcccagttcgcagaacaacaaaatcatcactctcctcgagctctctcacctctaatccttctcgctaattggatctctttaggcatgatcgtcaccctctttgcgtgaatcgcacagaggtttgtatcttcgaataacccaacaaggtaagcctcagcagcttcctggagagcagcgacggcactgctctgaaacctcagatccgttttgaaatcttgagcgatctcacgaacaagtcgctgaaacggaagctttctgatcaaaatctcggtactcttttggtatttcctaatatctctcaacgcaacagttcctggacggaatctgtgtggcttcttcactcctcccgttgctggtgcagattgtctcgccgcttttggcgctaattgcttcctcggagcttttcctccggtggatattctagcagtctgcttggtacgagccatatagaaagaatcaactggttaattttattaattctggttttgatttctcgaaattgttatagaaattgaaaagtgttgagttggttatgtggaaaaggagatgaaaatgtggagggagttttcaaactttgctaaggaaggagagattttgatccgttagatatcgaacaacataaacgcaaaacctaatccaaccctaaaacacgaaattagggaaaacgaaagatatacataagcataacgatcacagtctagagtacttcaatctccttcttaagccctctcgcctctaattctcctcgccaattgaatatccttaggcatgatagtgactctcttagcatgaatcgcgcaaagattggtgtcttcaaacaatccaacgaggtatgcttcagccgcttcctgaagtgctgcgacggcgctgctctggaaacgcagatctgttttgaaatcctgagcgatctcacgaaccaaacgctggaacggaagcttgcggatcagaagctcagtgctcttctgatacttcctgatttctcttagggcaacagttccaggacggaatctgtgtggcttctttactcctccggtcgccggagctgatttcctcgccgcctttgttgcgagttgtttccttggggcttttcctccggtggatttccttgcggtttgcttggtacgagccatttggtatccgaagctttgagatttgtgattaagtgttgaagatttgtgagatttgatgaagaagaagaagatgttgagactaaagggatactggattggtttttatagcgaagcgtatacaagggaagtatttgttttgcgtcgttagatcttttatttaatcaacggttgtgattgttttaattttagtgatccgcgtcacgtctaaagcagccaatcaggttagttttctttagcgcccaagttttttagcttccttcacaattttttagtttttttatttaggcgcgtcttttaaaccttttcgctaaattttggaacctgacagtgaaggcctctatgaaataaaagcccatgttgtagagtctaggttaagcccgttaatatgttgtgtatcagtccacgaaattataatcttagtttctgctgatgtggcccatgtagaatacataagtcgagaaataataatatcattgacgcacgttaactattattaacgtgtgagtggtgtaaaatcagccaatcaggctttaaatctagatacaaagattgagagttgagttagttgattgatttgaaattgattactgaagcaataatgttttatatttcttacatttctgtttatttaataatacgtgttatactcacaaattaaagtgtctgtaattttgtataatgtgaatacttacaaaatgtgttgagaaaacgtcattttaaaagtttttttagttcaattttcacttaaaataaattgagagataagtcaattaatagaaatcttatccatatacgtatgtaaatgttgtcagattttcttaatgaactttttatcaaaaatatatcataatcaaagtactctagatagaggtaaattaaacctttagtattcatttatgaaactttaagaaaataacattaaatttagtttataaatagataaaataataataaattaaatagttattgcaataaaatccatgtgtatttaattttcaaaactgaatatctaattaaatcctggcatgaaaattccatctaatacacatgttcaatagatgactattatacaacatatatatttgataccttacaatcaaatcaaaccaaaaacacattgtgaaacctataaacattattaaagcaaagccacattgctaaagtttcataacattggaatagaacaactatatttcaa

SEQ ID NO: 43 - DNA, 3000 bp, Arabidopsis thaliana
cagtcgaagatcatattcttatgtacactctctatttgttgcaaaaattaaaagttgggaatgggcattagagagtatggatcatctacattatgataaaataacctttgccgcctcctctcctaatattattaaggctttgaataaaccaaatgacgggcatcggtcatatttctgaattactcaagttcactaaggataaaccacactggtttatgatgatgaaaacagattattgtaatacaggtgcttttgaaatagctaagagtgtcatcacaggaatgcggtggcaatcttatgtagctcacagtttcccctattggttgagaagtctttttgataaggaattgacttatcaatagagtatttgagttttcacaaggaggttaggattagattttaggtttgtcttttataagagtagaaatcaaagttttttttaagtaatgtaaaatttgatacaaatcgataaattaataagagaataatttttttgaaaatcttatgtaaatatatggtcccatcaatatcataaattaataattgtataaatatatcaactatatatatctattatatgtaagaaacttcaatgatatataattctagtattgtttttttcatcttaaattcatattagttcttgtttgaatttagttcatttatttttattgtatcaaaaacttttggttttgttttttagacataataactgtttttacttgtatttggttcgaaaaatatattttatatatagagagatatattatattgtcatagaaaaataaaaaattaggaaattaagaaaatttatctataaattaatacctctataaattaatagaattttgcggtcccaacattattaatttatagaggttttacactatatgcgttgtgtcttaggtttgtgtttagtatctaaaactcccttgtgtttctcttttctctttggtatcatggcagatgagttatgggatgcattacaacacttagagttaggaagggaggatcctgctctgtttattccgcatgctacttatgcaactgttgaatctaggaatagacttagcttgattgttaggcctcttaatcctcgatctcaaaatctcaatgttgtggttgctgctttgccaagggtttgggatctgacgtctagagttcatgggagagtgattaatgcaacgtttgttcagtttctctttcagtttgaggtggatctcttgtctgtgctaagaagggaaccatggctctacaacagttggtttgtcacggctcatcgatgggaggtaaatatggcttttgagtacttgtctaatattgatctgtgggtgcaaatgtttgggatccctctcctctatgtttgtgaagaaaatgtggtagaaatagctcatggtttaggggaaataatatcattggattttcatgatgctactacaactcaaatagcttatattagagtgagaatccgatttgatattactgattgcataagattcttccaacgaattacctttgattctggtgagactgcgctgataaggtttcaatatgagaggttaagaagaatatgcagtagttgtttcaggctgactcatcataggaatttctgcccttatcaacaacctgagcctaggtctcttgttcgtggtcctactaacaaccttacaaggactagaagagaaggagtgtgtacccataatgaatatcatcgatcatccctgaactctcaatcgcatatgtctgaaaactcctttccagcgcctcttgaacctcctccaagagtggcagctccttctttgaatcctcatgaattggtggctgcttattttcctcaaggaagagcagtgtctttaccaaatataggaacactgaatctaatcttaatccatcatttagcagacaagcggtttcaaggaattttaacattcaaccgttttttggtcctgttattgctacaaatgttcctcgtgtggttgaagtaggtgagtgttctagacaaggagagtttggagaaccagtaaacaagatggataagggagactcaacaaaaaggaagaatatgggaagtgctagaagtgatgaagaagaaagaactcatggagttgttgggcataaggatggaggtattctgaaacctccaaagaagcgctaaacactctgaaaattttgtcatattttttgttttctatgctgcttaggatccatgatcgcagcttcaaggtttatataataagcgctgcattgggttcaagtatgcaggtccaaggtttgaataaggtgaagagtgggtatggccgttggaacactttttggttaaggctactctttgtgtgcagtttgttgtttcagtttacctatcactttttgattttacaacatgggtaacattgatgttttgttaggtcatgtttctttacttgttttggtgtttgtcttcaaactgaaagtggaaggtctactgatgtactttttgaactatgagagcagccccaacggtaaaatacattctcagtccattgtttctattattttaatcatttaagtataattttattatttatttatatttttagttacaaataaaaaaattgatcaattatactttatcacatataaagtgagtttttaagtacagtaaagcaaatccgtctttttaggactttctttctttctttcttacttctctcttactttttccaattaactatcattttttttctttttaagggacttattaaaaccgaccgctggggctactctgatcttaatatatatataaaaaaaagttgctccatgagttagcattgattacatttatcaatgtcttacatgggctacactaatgatagtatgttgggctttttatgtgtgctctagtagtattgtcgtttgtttgtatttgtactatgactcatcctcttgttcatcggatctaaagcgccactcaaaagggtttatgaaaaggttagggttttaacaacaactcaaaaaacagag

SEQ ID NO: 44 - DNA, 3000 bp, Arabidopsis thaliana
atgatcttcgaatcggtgacattgttgttttcagacaagagagagatatgtctttccacgttacaatgttgggacctagttgttgtgagatccaatatggttcgtgttcagacgaggagagaaacctcggtaagttgtgttctgtctctgactcttcaagaaatgtggtctgagtttggaatatggatcagttagtagagagaaccagtttaactatgtaacacttagtatctattctttttcagagaagaagaagaatccaaatggagaagcaaagtcttcttcactagatccttcttgtttttcggctaatgtggcgccttcgagtctacgttatgacttaatggtattctactcttaaatttgaattccaaattaaactatgaattcatgttgttttataatgaatttttcagctttttccaatgggttttgtgagggaaaatggtgtagtcggatctggaaagattgttctgatgaatgaaaagggcagatcatggaattttaacttgagacaaaagccatcatgcggaacagtttatgttagaggagggtgggtgagtttttgtgatgccaatggacttcaagctggagatatctacactttcaaactgatcaaaagaggaggaactcttgttctacgtttgttacccaaaggggcagagtcttgttcactagatccctcttgttttgtggctaatgttgcgccttcgactctacgctatgacacactggtattcgactcttaatttgaatcccaaaagaaactctcatactagtgtctgaaatatattaaacttattttgtattgttccagtatcttccaaagcgttttatgagggaaaatggtgtagacaaaagacgtggagagatgattctgatgaatgaaaagggcaaatcatggactttagatttgaaactaaagaaatcatgcggaacttccctcatcagacgaggatggagaagtttctgtagtgccaatggactaagagctggaagtatcattactttcaaactgattaagaaaagtggaactcttgttctatgtttgctctccaacgagccagaagaagaagtgtgctcagaagctaatgaagtagagtctctttcgacagatcaagaaagccatgaagagagtagccacaacgagaaaatctcaagaagaaaggaaaagaagggtagaatgatatggaaagcttcgtcttcaccatccgaaaaccgatttgtgacattaaatcttacaccttataacatcctacgttctgcactggttagtttcaaaactccaagccattgtctttttacagtccatcaaatttgaatcttttgtgtgaatctttgtttcagcgtcttccgatacccttcacgaggatgaatggtatcaatgaagaaactaaaatgactctgttggataaacatggtatgaagtggttaacgactctgcggttggtggactacaaaagaaaaagactgggaatggtaggaggctggaaaggattcatccaagctaacggtgtgaaggcaaacgaatccatcatgttggaactgatttgggaagaagaaacaagttgcgtccttaagttctgctccaaggtgaagctagcaatcaaatgaaaatgtatatgagtgtaatattgaaatgaatcaatgtttgactcttttatttggtaagatataactcttaaggtctaattgtactattgtagtatgttttctaagtatgttgtaattgtatgatcattggccttacggtgtgggatttgtgaatgtttgtttagcaaagaaaaggagagttcaactttatcagtttaaattagtgactaaaacattttgtgaagatttttaccgcacaaaataaagataccaacaaaagacataatatgatgagatgtacatatgaggagtgtgatagaataacttaactaatattgaagatgaatgtgaatcaaaagaaaaagttgtaaaaatctcaaaatattatagttatattcttgatacagttgggacaagtcactgatatccaaattataactgtaatagaaattcaatttttttaaggatatatgattttctatttaatttaagttattttcagcgttatatctaaaagaattgttagttacttagtttgtttagaaaaacaaaaatctgaaagaattgttaaaccgattcaagtaggttgataacaatttaccaaagtcgtaactaagtttcttggatgtttaatatcaatatgagttttgtgatattagtaattaacaaaaaaattatcacaaatttgttatctaaaatatattttgattgggctaccaatcatgaagttactttttaattaatgtgtaactagcaacccaaaaacaaatgtatttcgatttctcattattcaggttataaaacaaaacaaaagttgaattttaggagtccaaagcctggtagtactcatacaattttaaccattagacaaaaagaatattattattaatggattgaatctctttttttttttttttttttttgaggtttcaaacacaatcagagtgaattcgattataattcaacaatgtattttacatatgattgccaaaaaaaactactaaccttttctagaaagaacacttatctattgaattgtatatcacacaatgtagtagtatctaataatcattaacattaactttttcataatggaaaaaaatccagaaaaatagtagttggcctgtaataactgtaaattaactaaattacaaagaaaaaaagtaaagacaaaaaacaaatgattaataaataaaaaggaaaataattgtccaaaaataattaattacccaaaaggccccatgtgaacaaagattttaattggcccattctctcattctctctttaactctataaaacacagagcaaagaaaaaacagaggaggttgattctctttggcatctccgaatcgaatctgagaagagaagaggaagaaaaacgaagatcgatgttcgagagggaattag

SEQ ID NO: 45 - DNA, 3000 bp, Arabidopsis thaliana
aaacatttatgctttcattactgatgtagcatttgggattctgggttttcaatatttcaagctgcttgacattgaggatttagtagctccttttctcagtatgatctggctagtgagaaaagtgaaaccttatcttccaaaaaatttggtttagcctggcttatggatttctaattattaattgcacttctgtaaaaaaattcatgttacctctttctacaagattagatatttgacacattcatgtgatttgtgtgcgtttatgttacctgcctggtggattttatgattgttaaattttgtgttgcttctatgttttgtgtgtgtgttttactcccaaatgaatccacatttttaccttcttgaacaaaagtcccttgttaattgtgaccgtaaacagagaaattgactgtttaaaaggatcaccaaatagaaattactcgcatgcttctgcttctgttgcacaccttgctcatatttccagtttttcttatgggctttgtaatttatcttgtctgcgatgtacccgttagtgtcttcaaaggaaaataaagttacttgaatctatgggcaaccaaagatcttcttgccttagacgtttatctatctttctaagcctcagttctaaagtcattatgaatctgaacagggtcttttgtgttgttgcagcaaagtggcgaggaagtcgaatgcgtaagggttgactgtgatctacagaaacaaaaatctactctaggagaggcatacagagaaaaacaagaagttgccactcgatctctgtcacaagaagacttgatccatcaggggaggactaaccaagcaccaggaagtgatggatttacttattcaattctaatcagtttagtggaattatactttgtctggtccatacgaaataacttattctctgcattgataatacagaatgagagaagaagaaaacattgtagaaagtaagacatcaaagtttaatattctcttgttgtatgtatacctctgttttgctgtcaaagatctttgatctcctctgatatatttaaactaaaagatttaattcttcaaacatatcattataccggagagggagaggttcatattctaaaacatgtaagcattccgagcaaaagaaatgtttatattattcatccaaaatgttggttcgtgtcacacgataatacacattgtagaaggaagactagaagtagaaccagctacattagagtttaatgtatctatataataataagtcaaaaatacccacttggattattatgttcttatcatttttggggttatcaaagatactttataaacttttgacttttgcattggcattgtctttactccgatgatctacgcctgagagttgaccgcttcacagtccagtcttcaaattgttttcgcacttacgatatcattcatttctgattcgttagggctcccccaagcttacaatcttccttagtaaagtttgggaaaaaaacaaataacataaacataatcaatctcaatctgaaacgaactaaacactactatagttcattttctctcatatgtatataacaagataattgtcaaaacaaaaactgtgagttgtaatcaaatgatggcattgatcaatagtcattgctttgttgattgaagaagattccacttttaaggaaaaaagacagctacaataactaaattctttaaggttcgttagcaatgtaaccgaatacgtgaagtaacactagccattgtttaaagaaagagagtcgtcgaaacaaaacgttgactagcttatatgctcttataatgatttagacaactcacgtatatacgacgttgaagccaaattagttgaaatgtatatgtaaatgtagttgactttggtaagcgaatctccattttggtcttttaagaatctgtaacgcctggaaattgccaatacctccggttcgtatatctttatatcatgatttatgagtgcgtatatttgactttttcttgcaaaaccatacatacataacatgcgaatgtcttgtgtctgtgtatatgatatctaatgtatgggaaaacttggaatataggttttattttcttctagacaagatcatgaagtatagtacgtatcttttatgatcatctttttggtcagacgaaagaatattagttttatataatacataatttgtgatttgtttttctatcctctataagcacaaacatatactatcagattatgacacatcaacagtgctaatataacattaggctgtaaaatcaacttaaatattttgtaacacttttctcttaactattacaataaacgtatagctgttagtttgcaaggacagcgttaacaacttattgtatcatagtattgattcaaaacgttaattactgtgataactataacttattaactgaaatgcagacgttgacagacacacaagaattgaaatgtagaaacgcgtttatataagagaacgctaaatatataaatttcggacttttctagtgaaactctattagtcttcttttttttctttggtcaaaaaacttccaatacgaaattcgaacaagaagtataattagtgatcaataatgcgaatgatgcaataaaaagtcaaatgaaatgaaattgatgaatttaactgttatataaaattataagttgacagaatgaaatagtcatataattctagttctagacgtggatagcaaaaactttgtcgcccatatgtatataaaatttgtactctagttatcttttaagtatataaggcttatattatacatcgaagtcaatggttctttgtggtctgggtctataatcacaggtaagcacatcgtcatcgatttcattttcaaagtcaagaccaatctcgctctctatataattgttaaaaaccatctttctaattaaaatagaaagagtaaaagccaagtaacaccattttaaaaggcttcgctttcaattcagaaagaagagaatagagagcttcttcttcttca

SEQ ID NO: 46 - DNA, 3000 bp, Arabidopsis thaliana
aatataatctcaaatggtttgaaggaaactcgggcttcagaatatcgaaatcattgtcgcggatattagcacttttgagcatgaagggacatacgatcggatattctccatcgagatgtttgaggtttggatttgtttctttaagtactgtgcttcattatatttttgcctgtcaaagatcagaggtttatatcttagctttggcttgggattgtgattagcatatgaaaaactatggagagctactaaagaagataggaaagtggatgaaggaagatagtcttctgtttgttcactatttctgccataagacatttgcttaccactttgaggtatggatcaatgtctaacttgatagcttcttgttttcttggcaataatggaatcttgagattgtgttgattcactataggatgtgaatgacgatgactggatcacaagacacttcttcagcggaggaacaatgccatcagcagatcttctgctatattttcaagtaatatacattataacttgtgtatgattcagtagattatgatcaattgaaatatatcaatatgttgttgttttgttcaggaaaatgtttcgattgtggatcattggctcgtaagcgggacgcattatgcaaaaacaaggtaaaaaaactcggaagatttgttgtaaaatgctagagaagacgagaattatcttgtaatgtttgtaactttataattaaacaacattttgcagtgaagagtggctaaaaagaatggataaggagatagttgcagtaaaaaaaatcatggaagtgacttatgggaaagaagaagcagtgaagtggatggtttactggagaaccttcttcatcgcggttgctgagcttttcggatacaacaatggagaagagtggatggttgcacacttcctcttcaagaagaaatgatgatgatttctttatttttcttccaatttttcaataaagaatacaacaatcccattctactttgtattctatgatgttatggtttcataccaaaggagtttgttcaatctttttaaagtgacaatgttatctcgaaaaacatggggatcaagtatcatgaactggattcttttgaatcagtagcttgctttgttggattcagctccccatctacctccaaaatgcgagtgagaagcttaccatctaaattctcctgtttaattacatgaaaaccgaaaatcaaaactcaggaacgagaagcttatcatttgattaaagatcacaggaaacatgaatagagctgatgaagcagagaagcagagtgagttaccgagagacagtctctgtattttttccactcggcaacacactcttctttatcccattggcctttaacaaacttctccgagtaccatctgcagaaaaaaatcaagaaaaaaagatgcaatttttagcgttttggacagacagataaatacaccaaccaaagggaagaattagaaaggaaaaaggaataagacaatgccatccaaatggtccaaacctttcaaaagaccagaaatgaaatccctgaaaaaaatacccatttggctaaccaaagctaaacccttaaacccagcaactagctaaatccatcaaaaggagaaacaaacgaaactcacttgttgaagcaattgtggtaagcgtttcgcaaatcggcgcagggagaagtagaggagcgagctgaagttgaatcttttttcttcaataagcccattgtcgttgcaatcaccactaatactctgtcccaccttagcaactctgaaaatccatctatctataattcagaaaaaaaaaaaacctatatcatcactcttaagaaaaggataaaaatgtaaacagtgagacaataagaatctaacacaacaacaagcttcagaattcatcacaaacagagaaatataatccaagatgaccaaaagacaactaaaagattcatttttgatactctaaaaatataaatgaacataaccaaagttgcagaaagaatcaaatagagagattgtatcaaaaatgaaactcagacaatgcaaagttttaagaagtatgaagcttttcaaggataatagaatttcaatacccaaaaaaaaaagaaaaaaaatcagatctcagaaggaaaaagaattgaaatttaccctgaatttgattaaaacgggatatcccgtaaaacctcagattctccgagattgagagtctctcgtctaactcagaaaccgtaaatttaaacacccgacctagacgacgacgacgacgaagcttgggaagaactcgattggaaagatcctaacgacgtcgtttcagaagacgaaaaccctaggcaagaaagaaaactaaattagtctcgttgaccaaaaaaagaaagagaggaaattaacattaaaaaagagaaactatacaattcaaaattttaaagtcttattatgatgatataaataagggaataaagatcatcttcatctcactgttaagtataatggccgagctccaagggacagaggctacaacctgatgaagctacgtggaacatggcggatgctcctcgagaaacggacacgccgagccaagaagatcaccctggtcatcagtacaacatgggactcaggggatgttgggaatctgatcaaggagatgattgaggatatagaacgattaaatgtgtgttgttcaaactagatccgcgggactttgagttgacgagtagtagtgacattgaatcttcttatgaacaagtgtaatctgattaaacatttcttcactggtcaaaacacattttgtcatattcggcctagcttggagatgctaatggataatccaacgtcattgaatttgatagtgatattattgaatgttttgtaaatgttattaacgttgcgtcctctactagaaacgaatcactcgcgtggcgtaacataaaacaattgcttacaaccctcgtattataaaagacaaaactccaacaagagaaaacaaaaaaaaatcatatctgcaagtaatagaaa

SEQ ID NO: 47 - DNA, 3000 bp, Arabidopsis thaliana
agtcatatgtaattatgtaaacaatagtatcagttttcagaatgtacaaagaccaatacgtcaatatatatacagctatactgttaaaaaatatatattcatttatctgcagttaattaaacttgtttttttaattagcatgtttagagcgatgttatactgtagtagacaagagaaaatcgtttaaaaatttgtatcttcgttgtagatgaaatgtcagctattatgtgtactatatatgtaataccgtccaattaaatgcgatgtgcagctgatagacacgtgtatccaacactaaacatcacaattctcccatcacgtttactaattatggccattataattagcaaagttcacattttatgacttactacataattgaatgatagaggtgctatatggagtttttctcgatatttcgtataatcattaacataaatgcgtttgtcaacaacaaaaaagatttaataaataatctgaataataacaaaatttattataatcgtacgccaaaaatacgttttatagccctgcaggaagatttttacgtgaatgccacatcaattcaatgcataattttgtatacgaaccataataggacgaaaaaaacagtctttttctaactatacttgaaaccaattctagactcaagcgggaataaatacacgaaaccgaattcgtcttatgcagtacatagcatgaatgcaatataatctccataacactatcgctctataagccatatataactcatagtcacatgcagtctcatatatgtctcatagttacacatattacaaaatgtctttaacttttgtgtttcctttctacgtacgcatgtgatgatgcttctccgatgtcttagagagcttgggacgtgaaaggttgatgtatggtgttggatactatcagccaaaaaccgtcaagcaacatcgtacaagattgataaatgtctcacatgtgtagtacttaatagtcacaatttgactacacaaacctctaccgacactaatgtagcaattatatcatgttatatgctcttaaggtatagtatgtataacaacatttcattctgtaaaatatcatcatttatatcaaatttatgatatataaaatatcattatcattttaaaataacactaaaataatcagtgcaattccgtataatcttcatatgaaactgcaagaatccttggtgttccaaagattatgatgattattgtgagctttgatttatggtttccatcttgtcaaaaaatggcttttataaatggtagagctttcttagttttccttaagatatacacaacaggttacaaatataatttatttttgctaaaagaaatagttatagtaaacttgtaaaaactactacaactattttatggaaaatgtcttaaagctgtttcaacttttatacacattactgcatttactattctgaaatcaatttttaattaaggtccttgtactataaggaatcctttaaataaatataaatattaacaataaaaaaatccaaaatttcagaatgcaatggtcttacaattacaataataatgtatttgattgtactaaaaatataccttaaatactcaccaattatcttttataatataatccacaaatttctggaagaggaaaaacaagtaaatgcaagtcacatttcacatttcaaattaccaactaccaactacaaactacttccgcgtctcaaattgaaccactaattaatcactactttatatgctcatcattctttttctttcattacaattctagaataatgacttaaccaaaattcatacaaataaaacaatattttggcttccttcaccaggctaagaattttggtattgaaaatctaagtacttcataagaaactgttggaatcatttaaaatttgtgatcatatataaaaaaatttattcatctttatatttaagagtttaaaaactgcaacttttgtttttctttcactaagtcttatggccacagttaattaaaagcagatgaaaggtggtccaatggaaaaggagaatgtgattgggctagttgggagagttctgatgtctagtgttgggtacacgtgtccgtcagttacacatagcattaaatcagacggcatgtcattattcaaatctagttcacatagtacgactaatagctgataaattaatgattatacagcatatgaattatgaattcaaaaaaaaaaaaaaattgaaaatgttaaggagatgctatattttacaaaattcatcgcaatgctttctactaatttgctaagtggtcttctccagttagtcttgtcgattccaagcgatattattaaatcttgaagcatcgctcaaagcattatagcttaagataaccaaattgttattaaaaacacctagtgaaatttttaaattaaaacaattttgatatctttgtaatatctaatactactctttctgtgtctaaaaggattaattttcaaaaatttcacacatattaaaaaaaaaaaaaaattactagctaaacaattttcaataatcataaaacaatagtaacttaataatttttttttattttcaaaatagtccttcaagtttacaattcattttagtattataatcaacaaaatttgtattaaaaagttggaaaattaatctttgtggaacaaaaaaatctagaaatcattttttagaattagagagaggtttgataaaaaaaaataaaaaaaaatagagagaggtagtacatactaaacgatgtgatactactattgacaaaatcttaattctcagtttagtagaataaactagaaggaatgaatgaagtaaatgcgaatccaactactaacaaaccctacttagtcatcatattttcccatatgaaatccctatataaacccatcatcatctcccacttttttcatatccaacaacaaaaacataagctaagaaaacgaaactcaactaattttgttatcacccaaaaagaagttcaaacaca

SEQ ID NO: 48 - DNA, 3000 bp, Arabidopsis thaliana
cctatgatctatgaaacaaaatttcgctttttgttttgcaacaacaaaaactcattcaaaagatcaaatgttataaattggattattatatttcataactatatattgatgacatactatgcaacaattttgcatactatattcataactataataaaacaaaagcgaaaactaaacataaacctaaagctttatctggatgtgatgcacaaaaacaatttaatggtaaaagaaaattatgaatcaaggagaaaaccttgaggccatcgacagagaggaggccactaaggatacactccttaagaccagtcccaaggacaatcacatcatactcttcatccattattgtaatcgatctctatctccgttattgatcgtctttaatccttcatcgatctctaatagactttttctttggagagatcacaagtgtgagggaggaaaaagaaatagaggatgatgtgtggctgttaacacagtcttaccaccacctccgatcttaccgtttaaccccatgacaatttttcacgttaaatattaaaaccgtattgttaggggagagttattcgaatatatatggttcctatgtataaaaatggttacaaaaacttactataattagacgaacaggtggtaaaaatgtcctaattacaatgacaatcgttttgacctgaaccaaaaaaaaaaagttaaataggattgtataccatgtaagtatttagcgaccgtataaagtataaactcgtatatacgtatcgagaaacgcatgcaaactttttaatgacaaaaatacccttagtgttgcattcttcttatacgattaataatgaaaatgttatgtatatacgaggtccttttggtccactggcaaagaagctctgtatttaacgcaaacaaataaaaaaggagcaaaaagagtaacggagatatggtaagcgacggcggcggcgagaataacagagcggaggcagatcagttgcttgctacatcggagaagctcttggcttcaagtgactttcatggagcaaagacatttgcgatccgtgcatgcgaagctgacccatcccgaacagacgcagctgactatatcctcgccatcgccgacactctcctcgccggagaaactacaatcggagattccaaagtaccagactggtacgcggtacttcgaatcagccgcctaacccaaagccctgaacacgtcgcgactcagtaccgtagactcactcttctcctcaaactcaatatcaatcgtcttcctttcgccgatcaagcgcttaaactcgtctccgatgcttggtatgtcctctctgatcctccaaggaaatcaatttacgatcgagagttgcagctgagtcaaactggtcaatcggagaaatttcaagattcgccattgcagagccaagctgagaccttggagaatcctacagctacaagcttttggaccgcttgtccttactgcttttcactttttgagtacccaaagggttacgaggaatgcacattgaggtgtcagcagtgtaggaaagcgtttgaagcggttaaaacgcaaacgccacctgtggagagtaatggtgaaggcgtttactttggttcttgggctatgttccctgtaggattaacaagtcatcctaacacctctaattggtcgccaatctcacatctttccgtctgcacagggcaaagttcatctgatcagcaatcaaatttgaaggctactccaagaaacgatgatgttgacatatatattgcaatttctgatgatgattaaagatatgatgcgaagagaagcaagtagacaaatgttgtatattataaactcaaggctacttggtgaaaagtaaagctttgtatcttttgttttgtggttcccttagtcctttatgttgtatgtattgctagctaatgtttatgcctagtggaaactgacctaattttgattcgtttgtggaatcaatgttagatggaatccgtttatgtattttggtgcatattacgctttcggtatataatcttttgtatcatataagttcataaccataaactggttttatgtggcatgttttggttgcgaatcatgcctagtttgagtacatgaaggaatgctatatgtaaaacttgtgagggacgtctaagtaaggcattattctcagattagagttagtatcagaactagcagaatgttcattttcaggtggaaataggctcagtcttattttggctgcagaagaagttttgtttagaaaagggatcaattaagctatattgaagaactgtgttttgttaccgacttgagttttacccaaatctgtaatttttcttttgtgaagaatttttgaagacggagaatcaaataatacattgtacatgactttgatgagaaagaacaaacatacacacaaccataaaacaatccaagtcgttgtgtagattaccggccaaaacctaaacatcatatttttatcgccctttcatacttgcaaatatctaattcatgtgcaaacgtttcaccttaaaacaagttttgattagttagtgtttttatctcaaaatcaatatcgaaatgactagagtttttaagacttacataatttgatccaagtcccatcttgattttcattagcttttttgtatacagtttataaattatataattgatatttgtgtcatagtatttgcaaaatgctattctctagtttacaaagtttaagcctttttacgtgtagcttaaacatgaacacgtaaacactaaaaccgaaaattcaactagattgaaagtgacaatatagatatacagatagagaagttaaacgaaccttttttattattcaaaactctgcacagattttcccaccaaactccatctttcttcttcctcaaaacacctttaaatacccattcgaatcaaagatcataatctcatcacaaacacaaagcaacaacaaacaccacaaaagcaaaagaagaaacaaacgcaagagttctcaagcaagctcaaac

SEQ ID NO: 49 - DNA, 3000 bp, Arabidopsis thaliana
tctggagaagataatgtcaaagtcacaacagaaattggctagaatccagataagtttctgaaagaagagatgacaaatttcacgaaagaaccctagccaaatctgatctttaagacaagaaacacaaaagctggtggtcaaaagcaactcgcttttttcttttgttctaaaaaaaacaaaaccagtgaaattttgggatgtctcaaaaaaaatttctgtatttgaggtttttgtgcgatgggtacagattatcagaaattcagaatgttcctctcacatctttttggatataagtgattttcagctgttggatcatacatttaacaatctcagccgtacattttctgtttttataaaatagactaataacgagaaaccgagtcgtggagattaatgggcgtacaaaagcccattagagtagcaatcaaagcccatgcatcggcatcaaattgtttttgaggatcatttgtcaattgtcaacgagtagagccgtgcataccatacaacataaagggaaatagccatagctaggccacaaaaaaaattctactacttaaaacgccacattttttatacaaattatttgatttttttggttacactaagacttttttccactaaaatagattacttttacattagaaatatgttataaagttgtaattttgtgaaaataccattcctataaatattttaagatgcttgaaaatcatattttgtcaaaataatagaataacgtttctaacgataattagaaatcataaaataatatacatgttaaaataaaataaaataaataagtagtcagtacaaaagaaagtttacatgtataacaatttgccataggcctccataaatccatcatatcagaccactctaatgtttttacttgtaaatatttgatggacaaaaacaaatgctgggcctactatagctactatcatatggatgttacatgcagaaacaaaacatgcttttctctctgaataacgaactaaacatgttatggattaggccctaatagctagtccagttaggattttaagattttccgatgtatattaagtgtcaatgtgtcatacatgagcctctaataaacacacgcccaaaatcaatagaactaactaaccctatacaccgaagtaatatagaaccagcacgaactctagatctggaaaatataaatacaaaatatcttttaaaatgttttctaaatattattgtaattatcatatgaaaaaaaaactattcataaaaagtaattatcaacatatgtaatctttcaaagatgcacttgatgtgtgtatcttgttggttagaattttaatttattaatcgataacttggaaggcaaataacagtaaaaataataatctaactgtagtaaatatctccccacacgtcattttttttatttttttttattttttattttggcaactcacatggtttgattcattgataagtcagtttcaattttatttttctcaaatttaaataattctccatttctaaaaataaaggggcaaggtattggtacgcacatgagactaacattcatacctttttatgaaataaataaaacaaaaagggacacaagaaggaacgcaagaattttaaactgaaatgattgtatctctaaattgagaaaaatcccaaaaagaattagtaacaaattaaataactaagcggtgttgttttattcggaggtaaaatatatatatggagggtatagcgtcaactcgcttttttactacattttgatttctctcccaaagttctttaatttttgtttgggtatcacatttgtagtcagaaacaaaattgttgaatgaattatcgacgactattttcactcgttggaatagtcgggattcaatttattaaaccgtcgtaaggaagctaaagatgtaaaaatgatgatatacagacaatttggctagctcattcactttttaaatgggcaaaccaatcatgaatgctagtttaatttatcgtgtgattgattttttttttatataaaaaaatagaagtaaaattgtaactttttatgaaaaccgtcgtaatcgtacgtcactaagctacaaaaatacaacaaacagtgactaataagaaaatgtagagtgatattagatgaatttaacacgtggaaaaatcatgaggaggagatgattttttctgttgcattcccttctgtggttaccagctacgataacgttcacgccctcctccacttaaattagaatgtgagaaaataaaatagcaagaaattggagatcacaacagtattgagtgtaggacatattacaaaggagacaaaatcagtcaatagtaaaaaggtatcacaataaaaaaaaatgtcaataaaaaggggccattgtatgacatgaaagaacaaaattaagtgatcatcacttctcctcctttatcgagagcttcagttttagagcaacaatgtctctatttctgaagcccttcctcttcctatacgacaccactcttagtcttctcttacttctggtactttatagctcgatctctctatatataaatacttaaataattactgtgacattaagttaattgttatttctcatgcatgaattagttcaatggatggagtcttgaggatacagcagcagcccaaaagaggcgtgaagcagacaaaaatgctgcagaaactgaatggatccaactccaatacttgtggaccaaaacaaggagtgttgtactacttcccgttttcaagggtttggtggttatgtgtttggttctatccattatagtgttcttcgagagtttttacatgaactttgtgatactcttcgtcaagttatttaaacgtaaaccccataaagtgtacaaatgggaggccatgcaagaagatgttgaggttggacccgataactacccaatggttcttatccaaataccaatgtacaatgaaaaagaggtatacgcatatatatactacctttattaattacactcttttattat

SEQ ID NO: 50 - DNA, 3000 bp, Arabidopsis thaliana
tgggatcctctccatcgtttccatcatgggatacattacttacattgacttcatgaacaacatgggacattgcaacttcgagcttttccctaagcgtctcttccacctcttccctcccctcaagttcctctgttacaccccctcgtacgtcgtttgtaaaaacactactatttatttggatttgaatatatgcatgcatttataacatggcatcaaatatgttgaaggtttcactcgctccaccacacgcagttccggaccaactactctctgttcatgccaatatacgacttcatctacgggacgactgataatttgaccgactcactatacgagaggtcgttggagatagaggaagaatcacccgacgtcatccacctcactcacctcaccacacacaactccatctaccaaatgcgccttggtttcccgtccctctcctcttgccccttgtggtctcgacccccatggtacctcacatgcttcatgtggcccttcactctcctctgctcatttgccctcacttcagctatccctttgcgcacctttgtctttgagcgaaaccgtctccgtgacctcaccgttcactctcacctccttcccaagttttcctttcacgtaagcattttacacgcatgcatatgcactttccctctctctcgctctcttgacacaaacgggtttacttattatgttgtacttcacaccactattttccaaactttcacacacaaaaaaaacattgattctcacttaacttgtacgtactacgtaggaaggacataaccttttatacaaaaagaaaattaaaacaacctaaaaatgaacaatgaacattttcttgtgggtataccttttgtaagttgcatctaaagtttattaataattttgcctcataaacatgcggcggtagtataaatcacagcgccaccatgagtccatcaacactatcatagaggaagctatccttgaagcagatgaaaagggtgtgaaagtaatgagtcttggcctgatgaacaatgtaagtttatttacttcaaatccccctaaatatatatgaatcactattggataagtactgtaactaattacacacgctggcaaaagaaaaaagtaactaatcaacacacaattaattaatgagagggaggaactaaacgggtctggagaaatgtacgtgcaaaagtatccgaagttgaagataagactagtggacgggagcagcatggcagctacggtggttatcaacaatattccaaaggaagccacggaaattgtctttagaggaaatctcacaaaggtggcttcggctgttgtctttgctctgtgccaaaagggcgtcaaggtttgtgaatatatgagggaattggaatatatatactcagcttctcatatcaaacaaaaaataatgtagtaatgtgtatatataggtggtcgtgttacgcgaggaggaacacagcaaactcatcaaatctggggttgacaagaatctggtactgtctacaagcaatagttattactccccaaaggtgtggttggtgggggatggaatagagaacgaagagcagatgaaagcaaaagaaggaaccctctttgttcccttttctcactttccgcccaacaaactccgcaaggactgtttctaccagtccactccagctatgcgtgttcccaagtctgcccaaaacatcgactcctgtgaggtacatctttgaattcttatagatatatctgtaacttttatattatataagctgatagatgtgttcatctataatgaatgaatggttgttatatatatatagaactggctggggaggagggtgatgagtgcatggaaaataggaggtatagtgcatgcacttgagggttgggaggagcatgactgcggcaacacttgcaacgtcctccgtctccacgccatatgggaagctgctcttcgccatgatttccaacctctcccaccatctcctctatgagcttttttcatattcatacatctatgtcccctttcttgattatatctacttcccttccatcattgtttgctgtttactatgtttttctatcgacaatatataagtacccttgttacccttggtgccacgtgcttcatatatgttagaaagggcaaaaaaattcgtcgtatgatatgcttagttaaattttataaaactcaataaaaatcttcagaaacagtgctatgatcattacatcttaactaagtgatatatatctgcgtgcctatttaacaaaataaacaaaaaaacaaaacaaaatatatttgggtgcatcatcaaatcaaagtagttgcaaaaactggacgaggtttttacttaaatggtccttaccccgcatggtccacttgctacctaattaaggattggtagggtgcgtatacgtatataaattgtggcggtgggagatggagttactaaaaacgaaacgtacaagtattattcatagctctcgtataaggggttagtccttagatctagatattttcacttttctttcatttatgtcggagcaacagacactagctggcgcttcaacgtgcatgatcttgattggctagtaaattccaagcatcaatacctaacacatgcccaacttggttcattagtattctttcattggtaaaatacccttacctttcaataatatccagaaataaatatatgaagccatccatcaaccggtgcatttcctcaaggcatggatatgatatcagaacatcgatgaaggtgggagggggtaattagctgagtgtcataaatgaggatccatgtggagatcatcgaatggtagtagtacatgtttggtcttagctggccccaccacaaggaattggactggtgggaagataggggtggttacgtcattccacatatctaccaattaaggagtttaatataaaccttgctatataatgtaccttggctcacaagagttgaagagacacagtgacgacacaaacatattacattcgacggtata

SEQ ID NO: 51 - DNA, 3000 bp, Arabidopsis thaliana
ttagtaaatcccattgcatatcaaggccacacttcagagacaacaataaaagatgcattcattttatagacaaaaaagtactacacaaaagatttagaatccaggcgttgcaactaatgcaaattgaactgcacaaccaaacttgaagaactaattcagagccttgcgcaccaacgatttataattacgtcgcagtaatacctgatcaagtgcagaagcaaaaaggtctagaacatgaccctgagtgactagttgctttgcgatgctatcataaaacttgacagccttcttatagtacggagcggcatctttatctaaatctttgtgagaacgcacaggatccgacaaatcctttgagacaatctgtacaaaagagattacaaatatgcttcatacacatggtgtgatcaaagctcacaatgccaacaatcatcaacatatacttaccgttccagggccttccgtacatggacctccgatcaaagctacaattctagccccagttccaggcaagcaagctccaagcaatcctgcagctacactcaatgccacgcctgtacatcgttgggaccgatgacctggcttaacaggccactgatcactttgtagctcatccaaaagctacataccaaacatcattcacacaaagatagaagaatcagatgaaaattttccgacttgacaatcaaaagcaaagtcactcaccgagttgagtgtgaattcgcactcggaagcaggcaacaagaatctattcaaaccagaactcgggaagccattttgaggtcctttagaacctcctctcctagaagaaccaccaagccccaactgatccaaaatctgatctttcgaaatctctttatctcctttaaaaacaaaaactttagacatctcagagaatcccaattcatgtacatgagcctgagtaccaaacgacacaaatccaaccaaagcattctccggaagcaacccaatcgcttgtttaagcgccgatttagcaaaatccaattcttcttcaatcatacaagtatcaagaacaaacacaaacaccggcggatccaccagaccttccccgttggctacaggcggaggaagagtgtattcaacagtagtgtactgaggataaagctcaccaggaagattagtctcagagatcacatgataatgaggcgggaaatgattacgctgataacaaaacggacagatccaaagctttgcggtgaaatcgacttgtgcgtaagcgtttaacgcagcggaacaagtccggcatcggagcggtgcgtaaggaagagtagggatatcggcatgtcgccggatcggagaaatgcaagcggcgagtgggatcacgcatttgctagcttcagctttggaatgaggccagacgttccatgtcatacgaactccatcgattccttctagatctgtattcgcagtctccgccattcgttggaagcttttagatcagatcagagaatttgagttttttttttttttttccttaatgaagaaattgaaaaatctcaaaattctttggcgttattttttaggaactctaacgttgactgagtatcaaatatttctatttttgtgtgtctatactcatttcattttagttaggatcgaactgagatcgtagaaattgaaatggtaagtctaattactgatttgtattcctaagctcaaacttgagttttttttttctaaaataatttttcaaaactttgctcccatgatcatctttagccagtttcaccaacttatcttcatcacacttcacaatctccttcgagaagatccccaaagccaccaccgacttaccgtcaccgagaagcttctccacaacgtttctcccatgtttatgatacgaaagctcgatgcaatgccattgaagcatacatgcgatggtgtccgtaatacgctcgttggaccaatgtgtttcccacttcccagtgtttcctttgaaagggagagagatttagtttttggatttcatacttcacttgagaataaggtcttcttttcttgaaaacttgtatgaaatataacacgatgagataaccgaatttatcggttctaatatcggtgagcctttgcttaattgcttccaagaatgttgtgtcgacttcttctgattttcctaggattatttgaatcatgcatgagtgagcctcgcatggttttggtaaagtcgataaaaagatcagaatctgatgccaacttggaggcaatcctatggagctctactatgttggaacgcgagagaatgtcatcaaacttagccattatctcgtgcaagtgtggtcatgtgtgatttttcgtgtaaaatcgagcttaagcacatgttggatcaatgaacttcctaataagagagcgttctttgcgattaggtcaaggaagtaacctttgaagcgatcttcagctattgatatgactcttttgagtacacagcaaccgaatacgtcacccgctaagtcaaggattatttgaatcatgagcgagcctcgcatgatttcaacataataaccatgatttcaatacaattatgaattaaagtgatatatttttgtagtctacaaaattatggttattattgtaatacaacacaataaccatgatttgaatcgactgtttaaatttggagtttaccttcattgggcttcgtttataagcccaacccaacacaatctaaaacctcacgtgccacgtgggataaaaatatcctaagaataaataactcaaacggtcgaacaaaatcatgggccctaatttgatcttatccgttagatctatcatctcacgatcaacggagaatagatgaataaacatgtgaatgcgttctcgatctagaaattcaaaattctcgccattaacggctctctctcaaactctcaaactctctctctctcttcccttcttcttcgttactttgcccgaaacactgactgttgcagaagcagatttaattcttctttagggaatcttcgaattggttagcgcagagag

SEQ ID NO: 52 - DNA, 3000 bp, Arabidopsis thaliana
agaaagtgagcataggaagccgaggataataaagcgattccaagccacacgaatctttgtttcttaaaatgacaaattaagtaagtttcaaacaaacaaacaaaaaacaaaaaatgtacctttaacaaaacaaaaaatgtaagttgacgctaatttatttgtttgatccacagaaaatggtccaggaatctaatcggacggtagatatatcacactagagaacttcctcgagattaacagctttacgataaaaagttgagcttcagaatcagagtggcagatttagttaacggtcgttaaatacggctacgggcatatgcttcggctgtcagttacttttcatttttcaccaattttgccccttccgcatactccatgcatgcatgaggattgggaaagtggttgtctgatttgcacattccgatgatggattcacatgatataggctagtttttggcctccaaagtttttgctgttgtccttcaacaaaaagaaaaaaaaaatgttttattgtcgcagatatttaattacaagatttacctaattacgcatttgttatttatacatgcgaacaaactcattcttacgcgcgtgtcgatactaactatgtgccatgcctactcgactccattatatatatgggcatatcctgatctacgtatagataataattaaatgaatcctgtggaggtgaacataacacacaatgttgatagaatttgtcatcaacaggtggatagtcgcatggacaaacatagagaggttttggaaggggcactttgctccccatggttttctcgaacttaccaagaaaaataaaagacttttaaggttcacctgttttctttagaaggatctttaataagtatttgaaaatgttactaatctaaattaatgtgcaattacagacaaacaaacaaaaaacgaagagaagcgaaattaaaataggagaccagtacgagcggaaacgatgaaaaagacaaaacagcaggcatgtgcatgcattggctttggctattgatctcaagcttaataaaaaatgttagaaactatccctttcaattttcaatactccttcactatataccaaataaccaatttgatgactagcagaaaaatattatatttgtttggcttctttcaaacccccgattaatttattttggcgtttgtaaactcaaggaatcctatgatattattttttacgttgcgatttcgagtttctcctatgattgttaaattttaatttcttttgtggttacacgcatgctggatattatgctttagtaatgtgtagtcaatttttattacttatcatttaatccccatgacactagcttgataaatcgacagatatatattatatatgtaatgaatgtaagaggataatcaataattttttggcgttaatctaatcatttctagatacaagcgttacgaacaattcaaatgatcaaactttccttcttttgctattttatcataaataaaacgttagcctaaacggtgtttgtcgactacttgtggtcctctggcaaatctatgtactcatcgtctcattctctttattttctatcatttttgttgagttcttatttttttgtttgacactcgaaaaaatgttgagaagtaacgtaaccgactttgcattgcttttgttaaaccatcaaaatgaattgaaggttatgtaaacaaaagtagtagcaagggcccatgtttttgagctctgattacgggaggttggccgtagatttctgcggctgcaagttcttgaccttattaaattcaatagttacaattatcttctcgtcgaaaatttctgatatatttattttttttgaattaaataggaactggttacataacacgcacgatataggtaggaaaacacaggtaaggaacagagttataggtttcctgatacgtctatctcaaaacagaccactgtgacccacttagatttcagcttgatttttctatcactgtttttgcttcttttttacttttttcccctagttcagagttctaaaattgtaaattagttttatcgtagaagtaccaaatcaagtgattcaatggttaaattaaggtattaagttacatttgatatttaaaagtatccagaccttcattatagctcataagggttaacattttgtcgttcttttgtatattcatggcaagctctaattcatgactaagtcacatttttcaaatatgtttttagtttttacttatgttggtaattagtggatttatagttaagttaaaaagttggcgagttctagctttgaaactcatttagatatatatatatatatatatatatatattcaattttagtaaattgttaatctattctaatggtgtaactgtaacaaatgagaatgaaaaaaatatactattgtgaataaaaccccacacaacacattactataataagttaaacttctttttttgtaggcgcctggaaaaaaaagaaaagcaacaagagggctgtgaggacgcatcaccggtttcgtagcacacatgtgcatttgtctctttgctttttcggtttttttcttgccaatcaatttattttgttcctcagaaaaaagaaaatctaaaaccaaaatatatattataacctcatttaataaacaacaaaaatgtttgttgaaaaaaaaaaagtttttatttatcttgaccttatttctttgaagaaaataaagcttggttattaaagaagtccaagttagttgccaccatcagtggcataacggtaaattaaagccaacttcctctaactaaagttttctataaattcaaccactcacctcccactctaaaacccaacaacataatttcacatatctctctttctttctcttgaaggaaagacgaagatctccaagtcccaagtacgtaactactttctccatctacattcaattgtttctccttaatttctctagtacatatttacttgtgctataagtaattgattttatatcaccc

SEQ ID NO: 53 - DNA, 3000 bp, Arabidopsis thaliana
cgtcttctcaataacttctgatgtttataatggtcgcattttagttatatataacaattgaaccactgatcatctaacctcaagtgttcttaatttaatatcgataggtgccttatgactttcgatggtgggaagatcaaagatgtgtatatgtgtttcgccagcctcctcctggaacctatgacattcgaacagtctgagtaagatgaaatatcaaaaaaaaagagggaccctgagagctccatctaggtcccatgggtatgcaaatatttaaggctaggaaattaccgtaagagagttgcaaagaaaatcaatctcatcaatgaaattattggtcacggcccgttttttattgggccattactgggcctgttttataagagaatccagcaaagtcagcggtaaaggagttcttttttaataaaattaaaattttcttataaaaaagtgattaaaataacgtcacaccactatataacgcgacgggaccatcggtttcaaaaacataacataaaacaaataacatatttcttttaaaaattctttgtttttctttaaaatttttttaaagccatggttactattatactcacgtgattgtactgtagaatttaaataagtatgaagaaatggaccaccaccaaacatatccattatgtaaaatccaattgtatcctatcaattcatgttctaacaaatgtacatcttatatagttaatgcgataaggaggaatggagggaaaatctgagttcaaaacttgaacttggaccaaccaaacagtaaattttgcatgagtataaataattcttagatctctcttttaacttttttttttttgggtgactttgtttgtgttttgaatattagatctacctttttggtttgttgataaacattattaggtccatgacttcttgttgttatacgtccatctctcgttagtattttagagtcattattaaactttaagactttagagtaagtaagtcaaataaaataataagactttagatatacacaaccaagtttttagtttgaattcaaaactcgaacgaagtctgattatataatcacgtgttgtaactaatttcaaagaaactatgattgactcatcatactatgaaaatatcgttgacttattacagttttttcatcaacaaaatatatatacatctcatatggttgaagtataactactatcatatcatcattcatcaatcacttttgttgttactgttttcagagagattactacatagtagtacataacaagagaaaacaaagccatgacaagaaacatcaacaaaattctaaaaagcaagaagacgaagctggacaagatctctgcagcatttaacatacaccactccactcgcaatgaagttttatcgtgttgggacctccgattttggactttttttaattttacttactttggtaattaagtgatttttttttgctactacatgtgaaccaaaaagaaaatgaaaacagaaagttgtattaatggctagggattttaacttgtagctcggttgcttctcattaattagtaaacggtgtgaattaatggcatatataccattgtacgtaacaaggatcataaatgtggcaaaaattaaatcacagttgtagacaaataataaccccagatctcacgggttgatctcccaaatctatgtttaagcacgctactaaattcaaaaaattaagcactaatttaattaactcaagtctcccccaataaaaacacttcctttttgtctatctcccatatatgtaatggtcaacaagtcaaatttttaaaattcattatattctctgtacatgaaaacatttagtaatgtttctttttaaaaaacactgttttgatttaatgtcgttagtaaagtttattattttgatttctttttaactttccttaattatttctaaatgtgtcttctttatcgtttaaaccacactagtgtgtgcgtgtctccttcactttcaaagacagtctctttccccaaagagcggattcaggattcaccatctcgatctgtgtccaaagctcctatctttcttctttcttccctgaagaattttctggagcttctcaggtcaaatctcaaatctttttttaacttaattttgttatttctatcagaaagtttcgatttttatgctcatgcttgtgcatccgcgtacctgcatttcgttttgtgtttgagccgccaaagttttcaacttttttttttgggatttattgcaaatttgtcgatgttgaaaggttttctcaaggagaatgtgaagaaaaaggaagagaatgtgagttgattttaggcatagggttttgtgggttctttcagatttatgtagaatggtgcagctctgattcatgggtttgcaaatggtttctcacgatctgttcgttttcccaaggaaatgtagctgcttttttttttttttttgtcatcagattgaaatgtagctgcttttgaagagaaaagtctgatgcttctcttccgattttttatggatggtatttataaaagaaagaaatagtagttagattgtcgaatattggttttcctaatcttttttcttctctagattttataaaattggagtctttttctgcattactgtttgcattgttcaataaggaaatcaaataacttttgattctaccattgaatcttacggagttttgaaaaaaagtttgaagctttgaactttaatgtatcttctattgatacttttgttgatcagtggaaaattttcaaggaaaatcctctgtaagactcaattggttcgattattaagtcaaattggccatctttttttcagaacatttttatatgcatggttgcagattgctatctgctctgaatgttgatctctctattgccttaactaatgatctttgcgttcttttgacagatcagaggaagatgatgcaatcctaagactctaagacttcttcaaggctgtgttttatcgtgggatttttaaac

SEQ ID NO: 54 - DNA, 3000 bp, Arabidopsis thaliana
aacaagagaaatattggtgatttatttcccaaatttccgctttgataggtatcttcagtttaccaagccaccaaaatctaatgttgcatgctaaaaatatcatccaaactcgcttgaggttacatatggtatttcaagatttctcctgtgacgaagccacaagccatcctcctctcgaggagagtgatcgaagatgtccatttttaacactgtaaaacatccatgtttttgtccataagaaaactgtgaaactagggttgagcataaaactcgaaatccaaacacccatcccaaaaacgatccaaaaaattcgaattcttctacatgaattatccggtccaaaccaaaaaacaaaaattatattcgaaaacccaaaataaaattatatatctaaaactattagttatatcctaataacctagatatccaataaaatttagttgtatttgttaaaaattatactttttgtaaaattgaaccaaattttagtaagattaaaccaagttttaattaaaaaaaaaaaaaaaaatttagttttctttttctagaaaccgatcttaaactgattgaatccatccgacatatgtaaaactcccataaataaaggccaatggaccttgtattctgccaaactctttatgcaaacacacataaatttctctttgagattttgattctacctctacttcttatactcaatcagaattaaatgcaaaaaatcccaccccacgaaatcgaattgtcataaaatctgaagagataatacactctcccagaaccgtccccgaagttttagtagctataaaaaaaaactggttgattttcccttgagaaaaataaaataaaatttctcttttgcttggaatcaaaccagcaaccaattctttgagttactagtgtgtttccagctaaactaagaaattttcacgcgaaaatggttcgatttagtatacaaatatataaggcagctataagcaccagctttagtgacttgtacttttggacgtctctacttctatccgaaattatctgtatcctaaattatctgaatccaaaaaatctgaaacgaatccgattcgatatctaaatgttcatgtttctttgtaacggtcccaaagtgcaaatgacagatttggtaaggtgtcaaatataatgccgataaggacaaatttgaggaggtgaaagatcagtgtaactaaggtgtcatgaagtccaagagggaagcttgtacatgtggtgaatattggcttattacaacaatttttctttgcaatatcactatttttaaatgcatattatcattagtttttcttcgttatactcatcattaatgtattttgacaacattatatattgacagaaatgtttttcgacaacatcatatattagttgtatgaattttattcattaatttctctcttatataaatttatgtcatagttcaaacaagccaccctgtatgaaattgaaaatatgcttggttacctaggtaaaggtttctgataattcggaactattacaaatcatttataaaaatatacacaatctatataaaattgaaaatacattgtgaaacagtgacctgtttttacctttgtagagaaaattttaagtaaccattagcatgtgtcatgatgagaggtgtggaaataattaatggatgtatatatgtatctatatgaagtgtcattaaatccaagatccgtccaattataatttgaaacatcacaaagttgaaaaaagaaaacgagtacagagaaattaaatggcaatcaataataacaactaaacttgtacctccattaattcactagatgatcttagaagcttttatcaaaaaagtgtttggacccactttttaggtatacgattaaagtgcttgaaactcttcagagtgggtaatcttagtgcctatttttttttataaaattacaaatattgtattttgttgtccgtgtgagtgtgagggacaagagattgcactaaatttagttggtgtagtggtgcaacttacaacaataaccagtattttgacttttttttacatagaaagtggggttttttaagagctaatgctgattatattgtaaaaatatgtatatgtacactaatcaatatgagttttagtaattttgaatacaaccggaaactaccaacaacttacatttttgaagcgaattcgcttcttctacttgctcgttctattctattttataagatttatttttttttggctaaaattacatatagtataaaattgtttatcatttacagaaatgttgtttaatattttaatttaaaaccatacgaccaatcatagaaaaatattacataacataaatgtacacaaaatattaaatatatttaaaattttacgtaaaaatgaaactttttgttcggagattttaataaaataaaataaaaaaggagaagctttgtcttcagtgaaaacatataaatttatttcgtatgagacgaatcaattgttgcttgttgtcctagcatggatcactctaattagtagtaatgaggttttgctaaaagtaacaagatcagttgaagcaaacaaagatgtttttagtgttgttgtttttttggacaaagatgtttttagtgtttagctttggttattgtggtacaatggtaagtcttgatctttggagttattgttttaagtcgtagcttttattctctctttatagcttttttttagcttagtatccggagataaatttgtctttcaccggcttagtttttggaagggtttgatccttgccggcttcatgtatcaaaatactatcccaccgttgtaagttgtaatcctcaatggctcaatgaatgataataaataaagttaactctttcaagtgataaaaaaaaagaaaagaagaaagcttttatcacactttctatcccctataaatagaagggatggcttgaagacacatactgaaaacagaacaaacacaaacacaaacagagaatcaacgaagaagaaaa

SEQ ID NO: 55 - DNA, 3000 bp, Arabidopsis thaliana
ccggagcatttggatcaaaacacccaatttcttcaaacatgcctcctcctcccatgaaaaccggtccaaagggctaagaaagatggtttcaaaatcagaaaacattgacacagttttgatttgctagattatatattgaaaactgcaacctaatcttgaacaaatctgttctaaccaacttaaaaatcgtctaagcttagatgaattcttgtaatgtatatctaatgatcaggttattaggaataaaagagtaagagaagggtatattgttaccgacttggctgatgatgattctccgaagaactttttccgaattcacgccaagaagagacttaacattaacaactctttctttttctctctctgtctctctttttgaaatgcctatacgtttgcaatttgagagtaacaaataaaaagagtggaagatgacacatttaactttttttttttgtattaataaaatacgtctgttatttatttgtggtctaacggggaacaaaagtttaatttcaacaactaacatttttttcctttcaatatattttttattttctcaaaacgctagtgtttttttttgttcgtaccgtaatattcaaaaattgaaaactaaagttttttttttatcaataacaattaatggtggtactctggactggactttggttaaagttcagattttttttatgtgtgacaatacctactttgatacatcttactgaattgaaatatttggttaccttattggtaaaagaaatagtaattttatgacctaagttacaaatttgagttctttttctttataagttgcatcttttagagatttttttttttaagttacatcctttttagaaacgagggttttggttggatcatgaaatttttgtttgtggcaagacaggccggtggttagttacagtctgtaagttccatgacgtgtctctcttcgcgtgggtcccgtcacgattctctcaggttttgccgttttggtatatgatctttaggggtatttctgtctattgattatattttctcggtaatattacgcttgatttgaatccttcgactataatagagattttcttaatttcactttcacgttcaaagattttttcgcattgtcttttggaaaaatagcagagttttttaaaaaataaataagaaacgatacattcaaaaaatattatgtgaagttgagtttttttttacatatagaggaaataaaattgatcatagtcatagacatagaaatttgtcagtggaatcttttctattaggtcaaacaagattcaacttttaacattttatctaggacttctgaattctgatatacaatgatcgatgatattataaataagataaaaaggctttatttgtattatttccttgtaaagtaaagtatttcttaatttcatgtttgttgggtcatgcaaaatatgtttccaaggcaaggtagcggattttttgtgaagaatattagctgggtcccacgtgacacaaaagctatgcggaaaagggtgtttccgtaaactcacttgaaaatttctgctaaccagttttgtccggttaagttcatgttatgtatgttacaatttgggaattgggattcagttaaaccggatcagccgaagacattattatattcgttttgtaactttttgtttagagggtgtcgagttaggttatcgagctgagctgtatataaaaacatctcaaacaaaggtgaggaggggatgcatttgcaaaatggaattaaggggtgtttcgtaatcgtgacagttacgtttttggtttctctcctatgaggcttattttgggcctcaacaagaagtaggcgttttaacacgtttcgtcatctagagccagatgagagggcctaaaccctacctgtggctggttatttattgctttaacttacccgacagatgcgactcaatttgaaatatctcttttgggcctactgatcttattgacgagaggattcatcacccttttcttcggccacttggaaagattatatagattgtatgttttctcttttcattttctatcctcgtgaagtttttatttttatttttttattcagattacgaaaatcttgagaaaaagaataagacccggtgagcgaaaggaatgtgtggcgatggcgatgcctacacagccgtgaagccgagtcatcgattataaaatgagatgtgtcgatgataacattgctagtataattcttggtgtggtccattatttgataaatttatggtatgcgtccctcatgggaagtgtgataagattaaacctagtgttcgatataaaatttcaaattttgtgtcttagccattctattgaattttaaactacggtcagattgaagcttacatatatttgatgtaaaacataaaaatatgtggctgttactcgtacacatttatggttatataaatgaatagtctcaatcacagccgtgctctgtagttgtcaggtattcgtgtggtttgaagtataacattgtcaactatttgtataaagtttctctatactattagttccatgatctagttatatatacaagtcatatcagtttacactaaaccactcgacactcattgataatcgcataccgttactacaaaactaaattcaccttcattgcttattaaaatcaaatcatcacaatagctgatagatcgtggccttagcatttcctcggtaagacttatgaaaaaattaagataactattctttgaaaaaggtaaaggaaaagaagttgggaaaactttggcctttgtgtaccaaaagtagaaaaataatttccagcttgtcattttcctacggtcccaattaattatatctctctctataaatatagtaacacacttagccatcgtacacttactagttacttccaacatttggcttcctttgctttcacgaatagaaaccttagcttcttccatttcttctttctctcctcgtttaaattagtttttgacaaggaagaaaaag

SEQ ID NO: 56 - DNA, 3000 bp, Arabidopsis thaliana
tttcacttatgtattttaagtcaataatccttgtcaacatattccctccacatgatccgtttcaatatccacaaaccacaaccaagcaaattctttagctttctcacaccatccatattcactatcacttgtatgcatagatatgcatatagatgtacatagatatcttacttcctagttctaatttgagttacaaaaatgttgaaatttccactttgttgcagtgagttatctttagaaccgaagattctagcttttgaaagtcagcttgtttcggggcgacgcgatacaatcaaagtttctgcgggaaaaatcggaaatttctctcttggttcggtaagatttcactatacatccatatacaatatgatatgttatcatcgtcaatgaagagttttgttaattcttcaaaaggtttatataaacagatattcaaaagttgtgagacttgtggagccaaaggagcaattgaatgtcccggttgcaaggtactaatttgattttcattactagatactatgtaataaactaatacctttagtgtatgatcaatcttttccagaccatacctattcattttactctttcttactctatatttatgcatatactagacaaaattctcttgttgtctacagggaacaggtaaaaataagaagaacggaaatatgtttgagaggtggaagtaagtaataactaacaatgtcacatggttctcaaatatcaatctaaaaatttacagttcaatgagtacttaaggagagttaatttgggattttgaatatgtgcagatgttttgattgtcaaggatttggtatgaagagttgtcctaaatgtggcaagggaggcttgacgcctgaacagagaggggaacgatagacttatactatttgtttttcctacataagttaattttgtgatacaaacatgtctctattcctataacatttcagtcgtataatttgcatgtaaaaataaaaatcattaataaattatattttcgctagaatattacaaagcgtttagaaatgagaaagtgatattaacaaagtaaaaaaaaaaatgatatattgttaagaacacataaaatagtcacactttctgcttacaaaacggaaatgtaacttttagttggcttttaacacgaaatattaagttttagttgcgcttcggacgttatgtttttttgaatcgtgttttcgccatgttcttttgtgcatagggaaccttcgattccaattccatatcgatcagtgtacctccgaagaacctttctttgaacgtcgtagttcatgttagccaatagtcaggaagactcagaaggtagaagtgttgtacaacaatgtttggcatttggcgtagcgtgatgaaattagaagcttgtttgcggttagccatgttgggctttgcaagtaatggcccatgaccaatacaatgctatgaacaaaaggcccatccgctcatgactcttcttatgtttctttcttaattaagcatagattactagcttatgacaaaacattgaagattgaacagtagttaaattacgttgaatagtagttagattgtacggggttttctatataagaaaaaatgtttacgattgagaaagaaaaacagaactataataaacttatgaaattaagctttagatagaattacatcactgttgtaaaattcaactcctctttaaatattgaaaagaattctgataacttctgcaaaagtgcaaaggactaaaatacgtatggggcgtgtgagacaaaaacatttaacatttatacgattctatgcgactaatttatctaatcgcctgttatagcgacgttattccaatttccaagaaaaatcatcccaatgttgattgataccatttaagtaccttacaagttactagtaaattcattttaaaaatgtattctttaattggaccgtcgttacaatgtgaaatccgaaaataaaatataaaaaaaaacttaagagacacaacagtagaagaaggaccaagtacacatgcccaaacccaataattcagttatccaactaatctaaataatattcatgtttttataattgaagagacaaaggagagaggaatgtgataaaatcataagaaaggacacgtggaggtacgtgaaggaagtagcgtgtggagagagtgattggagaagagagagatgaaaaaagacagctacctactcatcttcccaatctatctacctactttctcccagatctactttttttttgttctttttaacattttcccaaaattaggtttaagtacttttttttgttaataatgcagtaaacaattgtttaattcaataatgcaaaaaaaattggtttaattttccgctaaacaaatttattgatattaaaacgagtttacaaaatcgttacagaaactaagaagtaaatttgatgatgttaaaaacactttattcactaactgattagtgattacttaaaccgttatttagttattttctcttttataatcgatctttttatacgaaagttacgcgtgactatatttttttatatgcaataagaatggttaaaaacagtacatgttgcaatgaattgtggaatttgtaaaatgattatgatattttttttgagcagatgagatgattctaaagagccaaaaagtcaataaccaaaaccgtacgatctacatctcagaaaacaaaaaacaaaaaaagttaggaaactccacccacgttcctcctgtgagtgtactacaatcaaatttgtgttttctggttggtgttacaatattctttaggcacaaaaaaacgaacacatcatttcatttgttagatacatttttatttttaactttggtattaaaataatgttaggtagttattataaataacattcaaaacgaaaacaccatcctacaggaactctcttccttgcaaaaaaaataaaacactatttcctccaaatacacgtagagagatacatatatacatatagagatcaacaaag

SEQ ID NO: 57 - DNA, 3000 bp, Arabidopsis thaliana
acacccttaaaagctttctttaagaaacgctcgtcgcttgcatctccagtcgtcaacttcacaattataattccactcaatgtttgccaacgtaaagagaaacaacagatagaaccaagagtatatattcaatgaaccaacctcaacataagatccaaaagcttccaaagcctttcttttgtccttcacaagtgctttaacccgagttcctttcacaatcagttgcagtataatcatctacatcagctaagaattaacagttctcagtttcacttttaaactttcatcttgttgcatccaatggatgatgcttctgtgaaaagcaaacacacctgacccaaatcactgtctccatcagttacaaaaacaacgtctttctctccatcaagatcatcttctttttcctctgcttcattggtttcaaatgagataccaaaatgcagataagagttatgtgcaagtcctgagattccatttcaaccattttaagtatcttgcattttgtttttaatgataccttcaaattcatcgtcgtctccacttaaagatccatcctttggccgaagttcaggagctccataccatttcctaagcttgggaccgccttaaaacaagaacacacaaagaccaaactcaagacagttaaaaagtctcaatttttcttctcataaaaaattcaaattcaaatttccatggcaatgagaataccttcgatataatcgagaatctgatccacaaaactgattttcttcttagcgaaacaacgaacaagacaacgttttccagatgttatcccaattcgacatttattagcttctgagtcctgattcgaagaagagaagagtaacgaaggtccttgactgaggagacacgaaggtagagaagtacccgccatgtctgcaaccacaaagataaggtttcgtcctcaccttgcttctactgtaaatctctcaacagttcacagtaaccctctagatgagaaagaggtttctctaaaccgggataactacaaaaatacctgctattggatcggataagattgttatgcaaggtgtccagagcaagtcctttcattttgcaaccttatctcaacgttcttctgctgataaagtttgggactttcttcataaaaatgtgtgcatgctagtttctagttttgttctctctttttttgtgttatcttctatgagtctctttattcatagatgttttcgtttgattatatataccttagtcatgttatctatttatgatgtagctcgttcttacttgagattgcactagtagtcttgcttaatgacatataaatcttgatttaaactccctctggatattctttcatagagaaaaaaaattcttatgatgattttattgttgttgttacttgttttctcagcattgatccatctctgctcaatccttacaccaaattttgatggtataagaggattcagtgacaatgcttatattaaaaatggagtttatagtctctctgaactatctatgtccaagttcttgggagttcggaagcaccttacatcgttgacatttgttctaagttttcctatgacaattcttttcgtttgcacattcagagatcagtttgagatccactaaagttgatgtggtctgatactcacttcttatcccaacctaatcaccatgataacttagtgcttttgcttaccgtcctaatggttttgtgtttagtttttttctttttcctttcaagtttccattgttgcaggagaaacaggtctactcagacatgcaacttccattcatgatgcagcaaaatgatcattgttgcaagagaagagaagtccacaatgatgtctcaaggatcaaggacattatttagcaacaaagaaatgttgatttatgttttcaactatcatgtactaagtaataattcaaactttgtgaaacatctaacaatttgagagcaaaaaaattacaaattaacatatgagtgtcaaattcacagacggcgtgcaatcctgatctagatagagcagacgacacggcgtgtcttgcacacgtgacctaaaacggaacgtagtttactctgttttggcatattaagctatttactgacgtggcaatgcttcgatatcggaccaaagctgaataggtatatacggattccaaatcacaaaataaagttatttttgagttaataaaacgctttggagtccgggacctgttaattttgctctaagcactggaaaaaaaaaaagcctaaagggagccaaacataaaagcagtaccaaaaatttccacttttctttaaccttttttgcttgtctaagaaacttctcctctgaaatcatcgtagattaatctgttttcttagacatgattaagtctccgacgctttgaggtaaccggaaagtgtaatcaatcgcttgttgctgtatttgtcactctccggcgacaaaacttgatttccggtggtaagcaataaaaattcaacctttttttaattcgtttctacatttcaagctttgattttgttctttcttaatatgttgttgttgtatttctgtgttgtattcgtaattcgatctaaaattgtcaaattgattgtgagaatgcaaggtcttagtttgtcaattgcgaaacttgtgaattctttggaatttcaattttttaatctttcttaattttgtatacttagtgttatacttaatattcaaagggctttacttttgtttgataatagatacttctcactttggggctgctttgttttcgtctgatggtgttatttgtatgagaatttgctttgtgttcaggtttttggtgtgaaattgtacagagatgctgtcaaatagtaaaagaattgtttttttctttggtaaagttatatgtagtactgaaacatgctttggtagattggtttttttagtacttgaagaatatattgagcatatatcaatttgtttgctttttctctgtttgggattgcagatagtgtgttcctaagttagatttgcg

SEQ ID NO: 58 - DNA, 3000 bp, Arabidopsis thaliana
aacgtaaccaatcggatttatcatacttctcattttattaatcttttaaaagcccaaactaaagcccaagcccatatacaaaacccttattcataagtaagagagagactactacttcacgatggcgggtcgtaggaagaccgaagacttgaacttgccagtcgtcaaagagtttggttgctttggccctttgtgaagtctatctactgcgtttgtaattttctcaaaaacaaatttgaaattcgttttgattgtatcattttattgacaaaaaagctttggtgtttgctttttactactgatctcgcacgcaaaattaatttagtcaacaaatttcgcttgcctaaaactaagttaaaacttaaaaacaaaacaataactatgaaacaaaaaaaagaaagataataagaacatctccaatggtttaaattatatactcgttttggagaattggagatgctctaagttcgagcaagctttaagaggagtccgatctaattgtcttttcaattattctccattaaacaaatcaagctatggatggaatcgttgaaactgtttgtttactacgtatgatgctatcatcgtatctcctgtatcggaatagctcttgccttttgtagtgtacggactcattgggtgcaagtctagtaatgaaaattgaatttttgaaataagtatactgtattcagcgttgctcttccaaaagagtatgagtatcttcagttaactaagcaacaaatgatttttcaaagggaataatgctttttagtctaaatttttttaaaaaccgtggaaaattataaggtagaaaagctgtgattattttctttccattttgtggatatttgattcagctaaatgctgtccaggtccagtgtttgagcgaccaagttgtagtttatatttttgtcatcaaatccaaacgaccgtaatattggttactacaattttccactttcctcgaatcttcagttttcgtataacaccataccgccaacaatttgtttagaaccgttttctatttcttattattatttgcttttgtcgttgaaatgcgttttagtttttcaatttgcttgttaatgttttaaattcaccatcttgtcttcttccttagaaaagtctcgcactccatcttttacagttgattttattccgacaaaaatacattacacgtactctttctcgtttcggattatttgtttttgtatggattttagttttccatctctcgaggtcagcttttttttttccacaactcgtgagacgtggtgacttgtgacttttttgacaaatcttactctggcgaatgatttctttatttgtccgaaatattgtctagcagatgagaaaattcagctgaaaaaaaaaacagtaaaatagtgtacatctacttcagcgttgaagcataattgttgaataaaacgaatgtatcctttatcaaaatatcttttgtctattacgttgtcatctaaattactgtatgatgttaagttaacgtgggatatttatcgatctttttttggcaaatattatttaatcttttgttatttaaatgagagttctttaaatttgtcacattaaaattcattaataataactaataaatagtgcatagaaaacttacaaaataatttttttaagacaattttattttctaaaaaatcaaataataagaaatagaggaagtattactttccaaaaaaactaacttgacctacattagtatataaacttcaaaacaaataattgaatatcattggtttaaaattatagaaaaatataaatcacaaaactaatacatttctgatcagttttaatcacaaaaactaatacatttttttaatttgtgtgtttttctataaaatcaattaaaaatgaactatatggcaatattgaattaaaacaagtggcaagaatttaattgtgtaatttatgttagagatcaaaattttctttccagaaattctgtgtacaatatatattcactttagaagttttaactaacaaaaacaaatttgtttttaaacaaaagaaaaaaaaattgtgagaaatttaatatgaaatatctggttatacaattagagattaaacagcattatagataaataaattatatactagtatgagttttcagccacacacaaaatagtttctgtctttctgaaccttgaaaggtggtacatttcatattttcctaagaatatttttaagttcgtctccaaaattccagaacttccataatatatataaaatactattgttaatgttatattattttttcctatttttaattgttccaacatactattgaacgttttaaacagtattatcttatatgtttcatgaattccaaaactaatgtggattttagtctataacgattcgatattagtaaaaatgatgattacattggctaaaagaattaaaaatcactggagtaatatattgtataatttggtaatgataaatttaattcataggagaaacaatatatggctaggtaagaaataaagaatacgtacaagaacctccatctcaatttattttccactgacaaagtctacacattttaatcaaatgagatatttatttataaccaatgaaaaactacaaatccacgtgtcaaacacttgaaaacgacggcgtcggctacacacgagccatgccaaatcaagataaaaagctctacgttccttctttaaatttcttacttggctgaacatacaaaactccctcttctctatcttcttcatcttaaagaaaaaataagagatattcgtaaagagagaacacaaaatttcagtttacgaaaagctagcaaagtcgagtatcgaggaataacagaataagacgtatctatccttgccttaatgttcttaccaaaagatctagtcctttctttgtatgatcgatccatcacaagcccacaacaacaacaactacatctctttctctatctctagcttctattattaatacattcaagaatcaaga

SEQ ID NO: 59 - DNA, 3000 bp, Arabidopsis thaliana
tgcatgtttggtttgaaagatctcttgttcgagtatttccatggatatgcttcatcgagctacttttttcatcgatcaagatcagactatttctaatattttaaattaataccaccacatttcaagcaacaataggtgaatattgtttattaaaaaatcgtaccgtcaattacaaaccgaacttgagcttaatatttaaaaactgacattagtttaaatatgcggacgtattacgtatatcatatgataaactataggtttatcttttaggttcaaagggactagcagtttatataatattgaagggcttaatttaacttatcaattaagtcttgtcctaactaattcattaaataagtataacaatattagaacaagcaatctaaaaaacgcaaccaactaaattaaataaacataaccttttcatccaacatacatttttgaacccatcaatcaatcatttagaatttagaaaaatgaaaaagaagagttggagttatgataataaataattttgtattaaacgaagttggactattcctccacaaggcgtcacgtatgggggcacatagggcttgtcccaacaagatgatagtgatatatgagtttggtataacattgatattctagaacacctactatctttttattgtgtgtgtatttatctgtttgtattcgtgtttttatatatattgaggataaaaatcggtgacacgtggttgcaattgttagaaaataaaattcaacggtgcaatggttggtgttaatagattttgactagggtgtgaactttacgaaatttttgattatttaatttggaatggaatatgagattttgccaattttctttaaaatatgtaggataataccaattacataaattgaagcattttaccaaaataaataaattgaagcttgtcatctcgttattatcactttggttgagtcaattgtgaaaattttgattatttaggaatactttttttttttcttttttttttctatgcattttcagttttaatgggtccgattggtgaccaatttttacaaaaacaatagacaggaacaacatgtttctttttttttaccatttaacagtaatttttttctccaaattattatatgtggacctcacattattcttaatcgttccttattttttgaggaatcgtagaagaaaattgttctttcccaaatttgatgaggaataaacagaaaaaaaaattaaatatatattaattaaaaattaaatttttaacctccacgtttgtttgatattttttcttaacgtccatgtttatttaatatttaatttagaaaatattttatttattttttcatttttatactatttattttatgtttgggttatcatttacaataacatttattctatttttcttttacactcattcctttttatttttattttataattttttctttttctatttattcttttttaatcatgttcatttttactctttgtattttcttataggttaccaatcggatccaataaattgtgttttttttggctagaaaaacattatgttcagcaccatatgctacactttcacgacgaatttaaaggttctgtggacagaagacaagtcaaccgcaaagcaacccaagttcttgaaagatgcatgagtagaagattcataaatatttttttttttttttttttttaaatataatttgttctcgtcgatcttccaagtaataacattttcatatgaatcgtatctaaataaaattatgttaatcccgcaaattcaaacctacaatatatccactatttttcttctgtcaaaataaactatcggtacttatagatccggaatataacataagatgataaatatttacttttataataacgataagaaataataaaaagctacttttggtaataaaaaaaaatggtagtaggagatttcaaagttgacaataaagcggctcacttctatatttggaggaaaaagtataatggatccgattattaatacaaacctgtacaagtttttgaacgagtaaaaaatcataagtaattcaataatagttaaaaacagtataaaataggggtatgagtcacgaaaaaaattcgaatggtgaccgaatcgcacattaataaaattctctgcatatatatatatatatatttgttattatttgaactgcaccgcactttatccgcagttgaactgcatgtttccattaagactctgagagtaatatatatgataaagcttttatttattataatcaggctcgactcattagggtggagcgaaagtgcgacggtccaaaccttatgcctatttaaaaaaatttacataagaaaaagttttttattttttggaaaaaaaagttgtcaaaatataattgataaaatccccaaatttctttaaaatatatattaaaaggccctgattttatttctaaatgacttttatataccaaagagccaatatttttgtaaaatgttaaaacactcaagatatacttcaaaataattgcaaaagatgcccaaaaaaagttttacctaacaaaaggtccaaaaaaaagcaaacatttaccctaagactcaaatttatgttgggccgggtctggttattattaaaacgatcaaagctagtgttttgttaaaccgcaattttgtagcatttcatatgttaagatttgatggttgaaaggaaaacaaaaattgtgaataataatggttatgagatctaaaacatcaaaggaaaatcaagaagagaaaggtataaaatattgaataaataatatgaatgtggcagttatagtttgatgtagaataaaagattaaacaaaaatcaagagccccaccagccactccttcaaacgtgtcctaccaactctcttctagaagcaattaggctcaccttccacctccaacacctctctccccttctctctccataaaaccctcaacaacagaatcaaaagcatcatcatcatcagaagaagagagtc

SEQ ID NO: 60 - DNA, 3000 bp, Arabidopsis thaliana
gatcggtcaataagggatataaatacaagatgatttaatattcattagccatcttcctttttagagagtcttatctattgccctataatatttgatttaaactgtttactaagattttgcgattgaccttatagagattttttgttggaggctttatgtgttatgtcgcatcaaatcggaattagacataaccagatgacaaaaaagagagcctttgcgtatgaatatgacagaattttgagcgtgtaagttaaaaagacgagattgtgggttctacttttggtagttctgctgattttgatagatcgcaaacgtctttttatgttgatttttcatctttttgttgattatttatctctttctttttgtgctttcctttttaaaactatagatctacttgtccggtgagacgatcgtatatataggatagtacacgttttggcatcaaacttgatttcctattctcgccaagcagttttaatttcttgtcttatcaaacaggctttaagattgttcttgagtaatatgcaatttagcagtagaaaaaaacagtgaaatattccttcaactcataaatcaatataattgacacaaaagaccggtcttatttcatgtcaatagaaaatggtattttctctcgtggtttgttacttttctgttcttataaggctaacctctagtggggatgcaaagttctagatttagacttgttcgttagatgactaggtggttagaatttagattcgcgtcgttgtttactgtgttcgggataatcgtttttagttgggatttgtcttcgcgggttcatctatcctttgctctactctgtttgtggttaaagattctctagtccgcgatcttcgagctcttatttccgcgagttttgctctcctccgactttcatgttgatctcatgagcttatcttcttgattttagtatattttcttgtggtcccatgtatcgggcttttgttttcggggatttctttattttctgccggctatgttgtacgaaaacgcattccaaaactgtatttcacccatgtattatataatgaaaatctttcagttaaaaaaaaaaaaaaaaaaaaaaaaaactagcttatttgggttgtcgtctatatcacatatctaatcgatgtaacaattcactgaatcgggtgttacaaataacatttgttttcttcactaaaagtataagatactggtacaacgcgaaatctaacctatattcgaatcaaatgacacgtcatcacttgggtgtctatttgtccacagttgaaagttataagaagcagacaagtgtctcataaagacatcgagatctgattcggttctcaggtacatacagttaatcgggagtgttgctttcccctagaactatggaggctactatttaagtgtcgttgtgtaacaaaaatcctgtgtttacttgcattacttaaactcctttactttaatagttttatatatgttttcgacctccctttttcgacggagtggatcgctatgacatgtaggcatctgattgtatttgctaatctgtttttgttagtatgttaaatttttaacccaatatatgtttatagtgcttatatattcttactttagttacatatgaatatatgatcattgatgaattaaacaatataatgtaataattaaatttgatttccctgatcgaattataatttatatgttttgtaatacgaatcaattaaaatattttcttgttacacattttgataaaatgtcgtagaacgttacttaaaagtaatgatgcattaacaaaatgtacaacatatattataaaagttatcatcaatattataggcattcgactttcagaatgtgtatcaataatcgaagtagtaatggaacgattattgaaagtatactacggtctctctttacttcatcgtggattctcattaaaaacaaaagtactttctctaccggcaactattgaaagtatattattgtttttaataactttgatagtgtttcttaattattaatcccaacgtacgataaaattttgtttgataaaactcacaaaagtttagtatatttctgtaaatatatgcatagaagtcatagtgattgacagaggaaagacgtctctttgactactcttcaatcgaaaacaaaatgtgctaaaatttcaaaagcaaagtccctaaactcgcctaactccatttctcatttgactttgccttaaatgtcaatagtcctatgttatttagctacattcaaaattgggaattaagaattattttagactccatatacttagaaacgaatccgtattggaaactaatttccatttagtaatagtatttaagtattattatgcttaccgagtagcatgtagtagtttcttaatgttagctaatttcaaagcaaacgacgaatattaaatcgtgattgcacacaacaagaagtgattaataaatcattaatttcgcccatagtaatcactaaccagagtaattttgaacaagactaaggatgtacaataacttacgtctgcgatactgtgtggtaataaatatagaaactttatgaaatagaactctcttaccaaagaaagaaaaagcaagagtgcgtgttactatacatctgaacaagtcaaagggtcaaaccttagtattttaaaattacacaaacaattgaccaaatggagagctaattatgtttagcataatttactatatagttgcaaaattccactttagaaacagaataaaaaaataaaaattgaacataacacttatgccgtgttccagtcactcttcaacattctactcattttcaaatatcctttttataaaatactacttttaaaattatttgattcttatgttccttcactatatatatataaatatcgcacattgcttaatcacttcaaatctaatccacaaaaccattcacaccatctcatcttctttctctctatctcttttcctttcctcatttaaagtttctttataagaa

SEQ ID NO: 61 - DNA, 3000 bp, Arabidopsis thaliana
aatttgtgtattaattacgttatacgtttgttggaataagtcatgctacagtagaaataaaagaaaagtcatgattcaaacatatagagactcgttaatcaatttacacgatcagataaacaaatgattgtaataaatctgatttagtggtacaaatagcaaacaataaacgatagtactagttaagatgattaaaatgtaaaaacatactaagaaacaaatagttgtagtatattcttttggtattacattttttttttgtttttttgcaattgataacagcaaaacaatagtatatttttactattgttataagctttttacatactagtaattaacctagcattatctaaattgtggaccatgggatgtcatttaagatatgcttttgcttgcagttctttcagcatcttttttgtttgtttttggtttaaatgctaagcatctattaattgtttccgattgcatttatgaatacaagcttaccaagtttatgacattaatattttaggagaaattttatatttctttaaaattttatttttttgatggtttgtaatagatagttttgcgaatatatagttatatatatatatatatatataattaaaaagatggttttgagaatgtttttttgaagcattacaaatttcctagctagggtatattctagatcatgagtgccggcgagtacatatatctatgtatataaatataatgcattatgtatgtataatgtcaaatttctatttaaatttaagttttttgagtagtcatccaattggaatcgtgcatgaaggcttgagagctttcaagtatttaaagtgagattataccaaagttcactattatatctaagttacacaatatcaagttgtctttttgatgtttacagactttgaaaagaaaaaaaaatcgacaggacgtatgataattgatacgtagacatttccacttttgtcttctgatacttgcacaacttaagcaaattaatactatcatatacactggataaaagaatctctgatttttaaaactcttcacctcgcatagtcgcatatctaagcttcggaactctatttttttcttaacaagacacatataattaagctgaatgttaaagtgatatctaactaattacttagaagttagaacctacctgtggctagtttcactaatttgaaaagaaacatataattcggagttgtatttaaattcgtatacgattcacgactcaaaatctaaaatttgatgacgataaaacaataggtgtcgtgcctcttgggtgaaataaattcagacttttatggtcaaataagaactggaagaaataagtggaaagtagaaaaaaaaaaaaaaggggaatatatttgttattggcaacttgtttgaataaattagaaacccataaaaggaaataaacatattgattattatagcacaaagttttcaatagaaatcagaaaacggaaacagagttattttatgcacggagatggaaagtcagcgggtcaactattaaaactcagtgcttaattaagtggtaagtgataattaactctttactaaattattcctgctggagtcctttaaggctttaactgatattttatctggacggcatctttttctgcttatagacttctagtattaactcttcatctggttcagtttttaatttttaaccctacaattttcaatagactatattaattcttatttatagattttcaaatatttttgtatttttcttaattggtttaggtttaactaagacctctttaattcttgatataaagagtattaactaaagacgagagtgtttttttttttttttttttgcaccaaaccaagtaacaagaggaaactaaaaactcttttgaagcatgtcgatcctaaattaagttttttatttagtgctcttttatcaacgtgacagaatattaaccacaataacatctaattttagtatttctgtatatgatttttttttttttttttttttttttttttttttgaaagttactactctcaccacatgggaaaaaaatagttttaccaaaatctgaaataacaaaacgaagtaagtactaacaataccaccgaagatttattgctggtcgcgttttttattactaaatttgatgttttatgtttacactttgactgtttgccaaccaaaaaaaaaaaaaaaaaaatgtttacactttgactatatatttatcataactctaattttaatttaaatattttgaaattattaatcattattatttatttgtaattagatatacgaaaatattttatacattcatatcatatagtcttaaccttcacgcacataaaattatagtttttgtttgtatgtgcgtatagttaaaaatgaagtaggctcaaaactatgattttttttattttttttaaatgtgaaatattccattgatgaattaaattcataattttgaaatttatgtaattatatggatacggaaggctataatgaaatttgaatgcaaagactcacttcccctaagagaataataattgttcagccaagtggactactcgtattcgatagtttttttttcaccttcacgaattctaaaactttgaagagcttataaacagaatttaagagtacaaaattataaaaaaaattaaatcaataaacatacagttcctgctgccaaaaaataaaaataaaaaataaacatacagttcctatattacggctgtctattcccttcatcgcacatgttccaaataattttaaaaaataaaaagaaaaattgaaaactatcttcttttttcttctataaaacccacaacttctctttttcttgtgcattcaaaactcatcctatctctatctacacataactccaaaaaacaaacaaattttctctctctatctctcttcgcaaaacaacatagaaaaaaagtagaaagtctcaatctttttgctgaacaatcttgttgtggtctcttctgtgtatatca

SEQ ID NO: 62 - DNA, 3000 bp, Arabidopsis thaliana
aaagatgtaggtcaccggttaatttcctgatttttctaatcacgtcttctgtttacgtagttgcgagtcgttgacaaatggttcccagagttaacaatcaaatgttttcttttgcaatttttaatgcagttcataaatgtttctggtggacttgttggtgggtccaatcctcctgctttccagcgcgcagagaaagagcgaatggaaaaagcagctagagaagaaaacgagggaggaattagtagcctaaaccacgatgaacaactatatgtaagttttggtgctcttttatttgaggattgcagtttagatattttcctccctacccaaagcacctgtattgggagcttgttcacttctgcttgtatgatattataataaaatctttcttgtgccgaacttttaacagtcagactattgcagtatgagcaaaaggggaaaacaatgttctggtgagtgcaattgttttctatcagattaaagttcttcactatcgtttgagcacttgagaatctatttgggctgtgtcgcagagaaaggtgaaaaagataaagatggggctgaagaacatgctgatacttcggatgaatcagacaacttttctgacatcagtgatgatgaggtcggtaattgtttagtagtaaatgctatgtcaaatttccaacctcgaatatggaacatgaaataaagaagaattctcaacagtttcaaagtcttgttttctcactacagtttcccttgttatatttgatcgtcagtcatagtattttactgttgctcaggtaaatggctatatcaacaacgaggaggaaacgcactataagacgatcacatggacagaaatgaacaaagattatcttgaggtgatttcagaggctatataatatgtatcttctcttggattccttttgatttatcacctaggagatcaaatcacatacaaaattatgttgttttgtaggagcaagctgctaaggaagcagctctgaaggcggctagtgaagctttaaaagctagcaactctaattgcccagaagatgcaagaaaggctttcgaagctgccaaagctgatgcggcaaaatctagaaaggtgactcagtttgaactttgaaattatgttcctgatcaagcatctgacttttggagaataacatgatacccattgatgacatatggtttctcaatcaatttctgattcttttttctctctcttcatataggaaaagcaacaaaaaaaagctgaggaagcaaagaacgcggctcctccagccacagcagtggaggcggtacgccgaacgcttgataaaaaggttagaatgtcagcttctttgataccttgatacttgaaaacgaatatgcaaaaaaagataaaccgagtatgccatgtatcatctgttaaaaacctggcctggaagtacatagtcaacaacatggctgtcgaaattattagcattgaagaaactttagagtctgtgtttcttcctttttcctgattttgagtgttgactcttacagagacttagttcggtgatcaactacgatgttttggagtcgctatttgatacatccgtaagtttttgattacctcttcttgtatcctcaattctcatcactttttgaggtctttacaattttgcttctcttttcttctttcaggcacctgagaaatcacccaagaggtcgaaaacagagacagacattgagaagaagaaggaagagaacaaggaaatgaagagtaatgaacatgagaatggtgaaaatgaagatgaagatgaagaggatgaagaagaaggcaatgtagaatcatacgacatgaagacagattttcaaaacggcgagaaattctatgaagaggacgaggaagaagaagaggatggtaatgattttggattgtattgatgatatgtattgtgaaacacaagagttttaatttcttttgttttgccggattagttgattttatttgcattaatataggagaaccccaactaaatttattctttattatcagtaacaaatatttaagatttaaaagaaaaaaaagttcacacaaatgatctatttatttttacaattcaagtggtactgactaagaaatgaaaaaccactaacttaattaatttaataaaatctatatgtatttaattttgataattttattttccttgtttatgataattctaatttctatcagataacaactaacaatcactgaacttatctcacctatttgatgagctaaatgtattttaaatttatttttctataaagatataactgaaacaaaagtgatgactttttatgaaaattcccaaaatcaaataccagaaaattcaattttaaacaaaatgtgtcggtccggatgatcttacatctagcttggttttacaggatagtatttaagaagaatcataaagttcatctcaaaccaaatccgacggtccagagtcacctgcaaagcttggcatcgtatacgtgttcagtggtcaacggatcagctacgagtgccgtttgaggttcaaacttctgtttctgaggttaactctctaccgttaacgtccgttagtgtaccttctaaccttgacgacttttccactttccaaaagataacgacggcgttaaattggtctattttactgaaccagctttaaccagaattagattgcattacattcaactcgtgcttatggataaatatcagttcggtttggagaaaataggttacttaaggtaaaaagaacggcaagtaacggtgtgacgtcagcagaagaagtattcgttataatagtgagagagagagagataaaacttagggaacccttttttatgttttattttctcgctttgtttcgatcaagtcttctctttctctctctatccctctctctctggttcaacgggcaaagtatttttcgaataaagttttggttttttttttaacgttcctttcgccttctttcttcttcttctgctggtgaattcgtgtatctatctatctcg

SEQ ID NO: 63 - DNA, 3000 bp, Arabidopsis thaliana
aaaaaattcttatcaaatattaagaatcataaatctttaattaaaactacatgcagtgatctatatttgattaattattttagaaattaaacagtcagtcaaggatgacatgcttatacattatcatttattcaaaaaaaaaaaaaaaaaatgtatactttatactatttataatttattaattaggcgacagctttgcaactacttctgttcttcagctatacgaatgcttgtaaattatgtagtgtatcatattaattataggtctaatatatattccatgaagtcaaaattttaccggcgattcttgtattggagtcaattgcatttatatttgagtttgaaaaggctaaagtttaagaaaaaaatggtaaataaaaatcccctacgtatgtgaatatatatgactttttcttgtcattcattaactagcattatgaaccaagaaatagtctaaatgtaccaaggtgtttaaactgcacgcgttcacataacaaaaacggtattcattttgtgttagttttctttacctattggttcacaatggtatttggtatatatgatatcgaatactcgtgtataaattttgttgatcgactattaacattgtaaatgtaaaccaagtgaccttcactagtttcaccaagtataatttaatattttagaatacatcaaaaagtttatcacttgttttcaacacgtaccaaccttagttttatgcaaggtgctaggattaacaccttttagaacaatatttgatgaagagagatatcatgtttgataaacaatatggaaaactaaaaactttttcataattaaagatggttaagctaggtgatgctaatatatctgcatatataaaattgcataatttagaaaaattatggatttatagaatcgcaaaatcaaaaatcgaaataaaaagttgaatactaaactcaggcaaaaaagatgaatttgaataaactaaacaaaattaaataattgatgttttggtttcataccatatcaaatctgagaaagaaacaaaaagatagagatgaaagtgattttcacattaagctgtggattatgtttacaacgaaatacatataaatattatatttattaggctagcaaaaccttaactaaacccaaacatgatgcaattgataatttgtctttctgacccaataaactgggtacataaattttatatgtcagtatgcttcatgttacagtactttaattatttaacactagtaacgcaaaaaagattttttaataaatgatcatttaatcattatcattcttcattaaacattatttattgttttctaataaaatataatgatggtttaattgttagtgtaaatttatatggtaaaactaaaacctgtaggtaagcctcttttcagtcttttgttgaccagaaactttgaacaatagagttctattttaacaaatactaacaaaatacagaagaagggtaaagttttaggttgaaacttaaaagggtgcgatacgtgtgaacgcgttggtcaacaaatactatcacgagctgttctctttcccgcggacagatattgattttttcgtgttctatttttggattttgtggctggtgtaataataatattaaagcatatatactagtataaaactggtaatttttcgtagaggattgttttctcaaagcccaaacagtagttgcaaatttgtaataaccagattttgaagtaaaataaaatggtgaggaaattttagaataatttatttatcaaaaaaaaactttagaatatgttacatatttggtagttatagtattgtatcaaatacacatattaatcgaattgtttgataaaatggaagtaaattatttttgactgaactatgtagcacatatttattttatatgaatctcaaaatcatttatataatttatgaaaaagttagttttttttctattcgatacgttaacaattaattatgaccaataaattgttttaaggcattcagcagtctaaaaataaagactgaaaatggcgtcataataaacgtaaatgcagtaaatattattccctctatttttgaatatttgtagtttaaaatttttgcacacaaattaagaaaacatacaaatctcatttaatttatctctttcttataaaaatattattaattacaattaatccaaccaataaaaaaatatgatataaaatataattggttaaaaactattaaacacatttaattttgcatagaaaagtgaaaacaacacttatagtaaaaaaaataaaaaatctttaaattacacttaattagaaatagaaagaatacaaaacgtacggatgttgttaacctaaacacgattactaccgagactaaagatgtctaagtttaatactaagaaaagtaaaacaatttttcgagcagatatatgaatagtgattttttgggtcaacacataatccacccaacgttgatttttgtttgtcgtttacaatctctaaaacgtttattttctaagaaatatacgtgtgggctcattttaatgcccttcgtgcgtctacccgacgactttgtttactcgaaactatatcacacactacaccacatatttcaacatcacactgtatacacacatttatatatacatgcagaccgattattataataatattttctccggtccctaaaacatatatatcattcattcccacatgagatataatattatgtaaaacatacttttgactatgttgccaataatcaaaaagacatctctctctctctctctcacatcctattttccaagaagctcaccaatgcttttgaattctcccacatgtcttttgacaattttagtataaatactcaaaccccttagtcagtcattctcatgttcatcaacagcatttgatctcaagctcataggaatttgatctccacattatatcttgatcatcaccacaagaaaaacatttcaacttcttttatcagcaatcacaaatcaaagag

SEQ ID NO: 64 - DNA, 3000 bp, Arabidopsis thaliana
aaattttcgatttattttgtacttgactggtcgtctaccgacttgtaaattttagaaaacttaagaatacaccggataaatgtatgaaagaataatttgaaaagtttttagtcatcgatcgacttgtgattgaacattgaaaattagaaacaagttaaatagtaagaaaaagtaaagtagtaaactatgtaatattttgattacgtatggaaaccatcagaaacaaatatactcatcctcctaatcatctcgtcatccgcatgattgacaagacaatctgaaacatgcataatatcataaatgggtatagctctcatgatcttttccttatattgattcattctttgccggtttttctttgcaaatattcttttttgttataaataaattatttataattacatttcaagaattttctttttaaattacgaattcgaatatccacacgaaaattgatttatatagcatattttgatatgaagaaattgtggaccaacagactgtaatatattttaaagaaaccaaactaataataaaaatgttgctaacaattatagtcggagaagtttaataatctacacataaatagagtgctaaaatagtaagcaatctaagtgacgaactactaaatgggtccagcaccatgtaccataataatcattctagaagctttataatcttaaacaaaatttacatattttaattttattataaagtatatctggggcatatatcttattgtaagacaacctggcaatttcatttagttttcaaggagtgtttgttttcaagattcgtagttcaaataattttctcgagttgtggatcttgtattcttgttcgaaacaaactcgtacatacatacatacacatataaatatacattcataaatactaaaggttcaacaatttaatgatacactagcgaaaatctattacaaaaattaataatgcagtaaaaactgactgagagaagtaagaacttgcgtaactccggtattcatcctcataccactgcgtttaaactttaaaccatttcaacctttgtatggctgatgtcagcagacaccttctctttttcaatatgaatatgtattggtttggttacttatcttaacttaattatagtaagacatgcgcaacaaatttagagtgcttttgtttcccccaaataattgatgtgcataaatggttaaatagcaaaaatgttgtccatacgtgtagagtctttgtcagaatagaacttttatatttttctctttaatagcaaaaattatcatacttctaacgtcattaaagattttgtctttgatgcttatctgatagcatcgaccaaaaactctacttcgaaatgtaaagtgaaagatttcttattaaacaaattcttaaatacaaattaccaaaaccacaagaaagatttaaaaaaaaagtatataagaaacaaagaaaagagtcataattctgataatttaacatgtcttcaaagatcatttttaaatttcatttccaaagttgaaatgttcagggttaagagaacttttttctctatcttatgtaagaaatattaattaacatttttttccctattatatgattttatagttatctgttttctatgaataatattattatttaacatatttggtaattatttaaattggtaataaagaagttttttctaatcaatctctatcgtaatggattgatgagatctaattttaaaaaaatcctaatgaggaataggtcctctctccacctataaatatatatatttaaaccatcataagaatataaaaaacacaacacgttaaaaactaagtttatagacaaggtaagagaaatctgctaacctaaaaattcaggtaatccgttcacaaaaaaactatctgcaacaatgaatagaggtaatcttataaacctcctaatgaatctattatgtgattaacttaaatatttaaaaattttaggggttcatgtaaagttacacgtacatcttaatctagttttcaagtacgaatcttgaacgtaaaaatgtttaaacattcagattaaaaaaagacagaagatcgtataatctttggttacttggtttaactaattcaagaaaaccctaacattgccataaatgttgatacgtacagccgaaaggccacatggatacaaggtgagtcatcgttactttattgtatggaaggcattttctgatttgtttattgcccgatttagtatacacttcattaggcccattagttagagcataattatatttttatatttgtaaactaatcacaaattactcttaaagcatgcctcttttttcgttattttattacacagatgttgagattctagtggctcataagttcctttcgagaatttaaagacaacccactaatatattttataatatatattttccgccgagaactgaatccagaacaaagttatgcctctgtgatgatgtctataagaaactttttaagtgtccaaagacaaaaccttgttgttcaagaatattttctttttggtgatgacgaataaattcatggtacggatctatgtatagatttggtaatagggtacttgtagaatcctaattgggtaagaaaataatgagctggttctcattatggtatcgacacttgttcgaagaatagtggcttctcaagattgtttccgtgattgaggaagtctagctagtaaaaaaaaattatgattgacgaggctaatgataatgcatatgctacatggttaactatagagtctataagtacatgaaataaaatatttagaatcaaaacacccacaaaaagtaagaagtgactgttgtcaagcatataatagagatccacatactatttatatccacacgcacatgttcaagcagagacaaagatatagaaaacataaacatagaagagcaaattaagcaacagtcttacacagacagaagttgtagaattgatttgtgagtgaaaaactatttaagactgaacaagt

SEQ ID NO: 65 - DNA, 3000 bp, Arabidopsis thaliana
atctgttctagaaactattaggaaacatcggagaactttcaagatcttgatccagagaaacaaacgaaagtcgaaaccctagctagctagaccttaaagattcagagatattatatatattacaccactcgacaatttagtcaaaatagtatttgtgatagatgacagtaaatagtatttactgctataatttatcaaagctatgggtgacttttttttttccttttcttgcatcttgaaaatttgtgtacattaggcattagccattaaggtaattactgttaaaagttaaaactacggtaaatatttttgaacttacgtgtactattactgtactctatttatttcacaaaaatgtgattttatatatttaatttttttttgtttaaatgtcatcttaaggtttacaaatgaatttattccaaaacaaatatgaagctaagaaaatttgaattttctatacttgtccaaaatttggtttgagtctatataagcacagtttagttaattgtatactgacgccaaaaggaaattaattgtaaaaagatgtatacaattttgtttttagctaaggattctctcttcttggtttattcacgttgttacccaaaagttctgacttagtttctatgcctttctttaccctctaaaaaatgcaaagcaatcaatattactcatcggaatattactaaggagttttttgggttaaccaacccctacaaagattttgggtgaacatggacatatattggctgagagtaaaattgcttccctaatcttgtaactaaacgaaacgttggtttaaaactcgcatactaataacttttagttgccaattcacttgatgaatgagtgcactcaattgcttatatcgaagcatatatactatattaatacaattttttttttctttttgctaagaatatcattattttataaaaaatgtacttaggtctacaataattgaaatgtagacctaaaatgttgaaaatattttcttatcttcaaataccttaattcttatataaaaagaaatcgacgcatagcatgatactcagcctcggtaaaattaaaagcataatcttaaccttaagaaccagacaagaagttttctgttgaattctaatcaatattataaacgataccaacaacgtaaaataatttcgaaatatacaattcaatttctgatattcagtattacaatataactagttatactttaacaacaaataaatataactagttagaggtgtctatgtgacgattttagtcaaaattattaataccatcatcctcgggacatgggttacgtaatacaaaaagacgtggcgtatggggtttcaacctattttgttcaatgaagtctctacggtccgttgaatttgtatctattgtacgtagtatcttcagacgattttttcatattgtattatataatatttatgttaattatttagatacgtataatattatttcctatccaatttaaaagctcaatacacaacgacgacgcgctttgcaacattcctctcgtttcttgtaaagtttttgaaatccttaaactgatttttaaaccaattcttagtgtatgagattacaatcattattgttttacaaaaaaaaagtttatcgatctaaatataccaacaagtccaacatcaccaaaagatctatatgtgtggacattttccttattgggaatgtggggatatgtgtttcgattatcttttatcaaccgttcaattcaattacctacaaaagctcacaagtcacacctgacaccactaattaacatttttacatgttcgactaaattcgcatcaattcaaatttaacttcttttttttcttcttttaaataataaattttgctacttattctgtgttttgttgatgtctatatttgattgttcatgagaatttgacgggattgaaaccaaaatatttggtttgattttagttaagttcactcaattttgatatatgctaagtcgacttattaagtggttactagttttatatattttgagatcatgtaatagttttcatatgatatgtataccaatttgatcacaacataactcacaaaatatcaatatttttagagagacagataattagtttaaattccggttggttctcaataacgcaggaaggacattgtaaaatcatgccacatatatgcatgcaagtggaaaatccaaatttacaaattcatattatgaaaatccttttattgtttaattcatgtatgcttttccaaatgtataattagaaggtttaattacataaatagaagttatatactcatttcactctcattgtggacccatgcataaatgcaatcaaagtctttgaagtctaaacccaatcaaattgatgaacacctaataaaatgatacatgcacatatgttctcgtgtggagacaaaattaagggtttatttgcgataatatgaaatgactaattacaaagagaaaatagtaggctaattttagagagagaaagcatggagtaatggtggagagagagagagaggaggctgactttggagagcaagagagtaaatgcatttggctgtccatgttgactctttgatagcaaaaccccactcttcattattgttacttttaactctattattattgctactaattcactcttcagcttaaacctctctctctctctctctctctctctctctctctctctctctctctctctctctctctctctctctctctctctctctttggctgtataaatatacacaagctctctctccacatcttcagacaaaaccaaccaccacttgtacctctttgtcttaagtactctttaaccctacaatttcctaagctctcaagccacaaaaaaccacaaaccgttcttcaccaatatatatatctgatcatcatcaaagtccttctctctgctcataccacaaaccgttccattcttcccctaatcacaaagtgatatttacatagagaagatagag

SEQ ID NO: 66 - DNA, 3000 bp, Arabidopsis thaliana
ataaaattccactaaatggtaaataactcgaaagtctcgaatgatacaatgaactcagtcaacatatatttgtttttccgcctcttacaccgactaatctaccaccgtgtgttagtattatgatctttatgttatttaaagcttatcgttgtttagatatatcgaacgagtttttctgttaggcaaaccttacaaaaatgaatttaaaaattaggagaacaaacccgacaatcgaagcatggaccctaattaacaacaaacagcaaatgatatactttgatttatatattcacacatcgtgcaccgtcttgttccttttgacaacaacctattaccaatattttaattacaatgtttctaagacacacattgttggaattatattctacatcgtgcaccgtctctcaggtatatgtgttcaccaaatgttcacgtgcatctttcaaaatctagctaagtgtacagcaaaagtacgtgtcaattatacattgacccaaaataaaatgttggatccgaaatgaaatagatctaaacaatgtttaagtaacacgaaacaatttacgacaaaaaaaaaaagtaacacgaaacaatttacaaatcctcaatttagtttacaaaccaataaaacttaacatggtatatattatagtctaattcaacccatataatataacctaaataggataagttttcgattagaaatacaccaagaaaaccatcatttaaatatgacatgttagaatgtggaacacataataaaagtaaacatattgttaacttttataaccaagactaagtgtattattattattatttttttttatttttttaaaatattaggaggttttgggccgaaacccgtaatctctacagacccaaaattacagcatataatattagtttcgtcactagaatgtattattagtatgaaagaaataacaattaagggaaagtttggtcagtaaactgaaaaccaacaacatcaaaactgaaatagtttcggtaatccgtttataatttgactaattagtatgtaactaattcgacataaaatacggaaaaagataaattaaaaaataagttgtgaaaccgttcgatgaaggttgggaagaaggtgcaaatgacgtttagtgcgttactaacgtaagagacagttacacacaatttcaaaaacagttccaaaaatttgacacgtggcagtttgcttaatggacgacagttagttgtttgttgaggattacagcctggattttcgtcaatcaaaaactatatattataaataaatatgatttcattcacattccaattggcctaacactcttttgtcgtgttgtccatgtcagcaaattttatttttatttttccgaccacttacttttatcttgtgtggccgtttctttgtaacaagtttatgaaacagaatattaatcgtatctaatcatataaatgtagtttcccgtattgtgtaaatactatatgactttgatttggggcattcaaaaacgtaccattaacaaatagtcacagacaaaaaaaccatacaaaactgaaccacatttctataaacgatacaaatatttttatcccaaatttgtagcactaggcagtttgaacctttttcagttagaaagataaaccaaaaggaagtaaaaaatattaatttcatcgctcaaaactgttacaattactgtttaaccagtcataaattagttaatgtttttttttaaaaatgtgtaatcaaaattttactttcaagagtgccagctctatacttgcaattactttaaaatttaaaaatatacaaattttaaattatgtgtattgtattctcgagaaaaaaaaaaaaagaaatctatgaataattaaaacgtagcataaccgttacaagtatagtttcaaattcaacgaatcaaaatacttttttaaaagtagctaatacttttctcgtttcaaattaaatgtcgttttgcatattaatttttgtgtcatattaaacgtcgttttatattctatgcagattttatgtataaactttattggtcaaaagcgttacgaatatcgtttcaagttcaacgaatcaaaacatattttataaaaacatctaatacgttttccgtttcaaattagatgtcgttttgcattttaatttttgtgtcagtctaatgtcgttttatattttctacacatttatattttcaaaaatttcagttttatttttattgtttaaatatatcatccaatttgaaaataatacaatacaataacaaaaataacatttaaattaaacaaaaatatttttagaacactgtgatcaaattttatcctccaatatttcccgacccataaactttaaaccttatgtaacttcaaaaaaaaattcaaattagtcgttttgtattctacaaaataaaataaaaggaaaaaagtttcagagaaaagggtaaatttgcataacaaggaatacaggctggcgtgtccagtcaaaaaagtcagaaatctgcataaaaaactgtctttacccaaactgccaaacctaaccgttatcgtctcagatattattattatttttcaaataaacattcaaaacagctttctaatttttcacctcagattgtgcgaataatatcagagctctttccttgtaggtttccgtgattttgtcgctttaacttcccttcttttcccactctcttctcacgcgcgcgtgcttcccctttctctctttcgactgtatcacacgctccataaactaataaacagacgcaccgagatcacgacacgtgtacacctacagctgtatcccaaaactttcaaaaccgcttgcgtggaagaagcggtgcatgactttctccaccgtctctaccggttaccggttattatccatcctcctctctatctctctctctgttataaataccttttttctcctctcttcagtttcctccaccttcttcttcttcttcttcttctctacaacaaacaaacaaaagatctgtttca

SEQ ID NO: 67 - DNA, 3000 bp, Arabidopsis thaliana
ctcgagaagaaaatggtgactgtgtcggaaactgactagtcggtgattgccggagagatagctatggccgaagaaaacgcggcggggaatgcaatttgttcaatctgctacgaagatcttaaaccggtggttgagaatctgcaatcaatctccgcttgtggccatgtctttcacgaactttggttagtacggcaaaatcaattctctaatgaagtttattatctccgaaattttatagatttatgtgtttaatcgatttctttcggaaaccctagtttgcagcaatggtttgagtattgcccgagtacgaacaagcgaaattgtccgatttgtaagcagaagtgctctctaaaggatccttgtcgactttactttcagtcttctgggaatcaaaccgattcgattgcctcggataaggttgttggaatcgaagaagatccggttttgttgagaggagaagtgaagcggcttgaagggaaggtacagaatcttacttcggctctggaggcgaagaaaaaggagaatgttgaagtctctgataaggttaattttgttcatttcgtttgattagaatggtttataagataagataaggttatgtgattttttttttttttgtttttgtttgtgtgtgtctcagttgcatcaatgcaatgagcaattgaaggaggataaagtgaaaaggtgggaggctcttcaagaaatatcaacgactcagcatttgcttaagttaaaatctgaggtttgtttaaactatacaacatccttagattttagatcctttttgcttcacaggcagaattttgtgttgagtttcttagtgtgtttgtttgttacaggaatgtatccagcttaactcacagtgtgttaagctacaggagagaactgtggctcttgccaaggagctcgcatcgcttaaattgtaagataacatctttcatattgctcttttagtgtcttcaggttctaatttaatcattcactcgtatggttaaaccttttctgagtctaatatcttgttttgcatccagggtttctgatttaagcttggaggaagatgatgtactgaagttggccttgttggggaataacgcgaagacgaaagatacaatagacacactagtcaagtccttggttattcggaataggtttgtcacatagattagttccactcagttcacatggcttcacttagttttggttatttgatataggtaggtgcttagcacttagttgtcactccttccctgctctcattttggtcattgacttagtgaacttggttcattatttcccatttgtcatgtctacagcagtgtaatccgattaaaaaagattaatttgaccttcagtgacttatgaaatggtgatttaccttagttcattcgtaacaacaacttgttaaactgaaattacgaaatttcataagtaggtatggtcaagaatttgaggaaaggaggattgaacattgcgtttcttttctcttaggtctttgaattttcttttatgaagtctctaataaaaaacaatctttcttactctgacaggagttataaggaattgctagccaagtgcaatcagctgggaagaggcgaagcacgatcttctgagaaacttgaaaaagctttggaaaagatagaaaaactaaaggtgtgtgttttggtgtttatctcgatcttctttgtgtcttctatatctggctcttattatgtttattctatgaccagaaacgaatgagggaacttgagttgataactgaagagagagagaacagagctctacgggacataaacgtttcaaagaaatgcagttacacagaagtttccgagcctgcaatcgagagcatgtcttctttcagaatgctttcatcagacaacaaagtggagaaaatctccacaccacctggtaaattagaagaaaaggatggctttaccattcaaggatcatgcttaaggggaagagaagactccttcgttagcagaacagactcggttatagatgtagatgatgattatgttcctgaaaccaacacttctggcattagagattggaatactaatattgaagagaaaggtgataattccatggtgaaggatataaagttcaacatcagaaaagacccgacatcatcagtgtcaccttacagcaatggtacttttgttgtacatcatgaattcaagttcttgagtgtagtagtagattgaagattgtccaatgcaggtagtggaaacatttggcagtcaagtggaacaaatagaaaccttggtagatggagcaaacatggagagagaaacgaagcaactccatcactaggaggttctgttccaagaaaagatgatctcatctctattggacctgatggtaaaggtggtagaatcaaagtgctgagatctaaaccccaaatttctgtgagttttacattcttcttcagtttctcctctcattaatttccactaccttgcctaatgtgttgatatctgtgcatagaaaaccaatgcaagctcaggaagtggtaagagattcaagcttggaactaaaacaagtggctcgtcctctcaaggttgtcttcagatagaacactatttcggaaaaactaatcgctaaattttcgacaatgtaactttttgttggggctagtaaacacttgtagttaaagaatgaagattaatactactatttaaatagtggattagtgataaacaaaaattagtagttactagccaaaacgtgagagcttctccgtcctcgagatcgtctccacgcggacatctttatagccgttgattcttggtttaagtgataacactagtttaaggcgtcagtggtatagtctgggtactagagcaacgagaccctaacacgtgtaaaggaaacaatattatgctcctgaaattacaattctacccctctgttcttcagccacaaaaaaaaactggcgaagtcaaaatcttttgacagtgaaaggacctttgaagaagaagaatcgcgatttcgagctct

SEQ ID NO: 68 - DNA, 3000 bp, Arabidopsis thaliana
ttagaaaaattattgattgtagagaggaactaccttttggattaaatttttgtaaaaaattacaaattttttaaaatctctccataaattaataattattaatttatcgataaattaatacctctctaaattaataaatttttgtactattattacctagaaagtgaaaattgacctacaaatatatcttcaatttgattcacatatacgaagtcacgtatgtttctataaatttagatccaaaatgtgtgaaaacccatctgtttttgcaaattcttgcaattgcaattgcacatgtttctattacgtttaaatcaatcgagctctaagtgatttatccatagtgatatacagatccaatatccatgaaacatatttaattcatgaaaaggctcaaacattatcaacaaataagatatggtcaactatgtagtaactagtaacacgtaggctgctgctctttgtggcaaattcatgcgcaagcaaagcctctagatgtttgacaagttactaccctaatatagcatcactagctatcttctaatttttttttttagttattttaatcctgtattcttttatttatttatttgataaagtgatgaaattttattctcctttttcttatcaactaatatacttattcattcacataatttcgcactttgcggagttttcatttgtcgttaaacccgacagattcttgaaccgcaaggaacgagacattaacctaatgtacttatatttaactatagtattataatagcataaatgtgacaatgattcgatcactactaatatattaatcaccaatctatatcgtcgtccttcctgattatttgaagattttgtctataaactagctgcttttgtttatgtatttttattacttggatgcttttgtttgttggaatattcgaatgaatttttgtttgcctgaaactatgcatatataataaggccatatgcgccaataatatagaatccaaatattcattaactataattagtttgttctagagttttagctactcatatattcaaattcttaggagatcaaaaaagtacttaattagttaataaaatccatttttattagttgtaattaaatgtaaagtgtcgaaacacgaaagggaagatgagttgcacaactcgtggttcctataagagtgataatctatctgacgtcacgccatgcaaaatgtatcaatcaattttcttctcacatttatatttacttcaaaatgattataaagccacccaatgaataataagatatatatatatatatatataactcaaaatcaaaaatttcaaatggaatttggaagcatcacaaattcacaatcatgtattcaaaatctcacgtagaaaaagctaataagtccaaaagattggtcttcatttttttcttgagaaagtttgatgggatagagagagagacagagaggaacagctaaatttgctgtgtatgtatttaatacttgaacatttatttatctattttcttatacatcaaactcacgaatttataggttggtaatgtcgtttttataacattaataaaaattgcaattgtagtttttattgaaatttacccaaaaaaaactattatacgaaaatatgttatttatttaaaatttgatattagatgaatccagaatcttttataaaacttggtgtgtgtgaacctgcgttaatttgttaaatacttttcacgtaaaaatcaaaattaattttaaaagttatgttaccaaacagtattctgatagttttacaaattttatccattgtatatgttttgtttttgcaaaaaagtccaaaggaaaaaacaaagcagaagggttgaattgtgaggaaagagagagtacgtggcatcataactttggcgacagctaatgtgaaaacagccaaaagctacggagagcgacactcctcgacgacgtccatgtctctttagattgtgattgcattgttaattatcatatttatcaattgattagttaagtcttaagtatcatcacacaagtttatacattaatctatacagtgtttaacactacaaaactccccaaaatcacgtgtttcatatcatacgtacatttgtctaccgtctttattaacaatattaaaacagaatttatcaattttctagttgaatagactatatactattatagagactcttataaattatgaaactcctaatcaattaaaaatagttaatttgaaacatatcactcgaaactagggtattagttggattgacgatatttttcttattaatatcaacgagaagaatcaagtgtcgttagctcaattggtaaaaaatttaggcaaagcttagagatgtctatttgagtgacgcttggaacaaaaattacatgctatggtttcaggcctagagaaatgcttcgatccagaatctcttgatattcaaaaaaaaaaaaaaaatcaacaagaagaatgtataaatggtttctatactatctaagttatgaaaaatatttttggttacccaaattacaagatttgtaccgaagtgtcacactagattcacatgcatgcatagttataattaacttaaaacataaatgacttacaaaaatacttacaaacaaaaaccaaattaagttatttagtggccagctttgttactagagttttagccattatcataattcacaataaggtgtaggaaaaaacattaatatatagtatgtatacatccaaaaaaaactttttggaaaaaacaaattttgggattataaaggacacgtagcccaatcgatgaacagaggacggcaccgaatcaatttgacttcaccttttttccccatatgataagagtctcatctctttcctatatatatttcgtacctctctttaaggaccctacgtctctctctttctctctactctctgtttcctcataattcaatcactatatttttttaaaaacatttgacttcatcgatcggttaacaattaatcaaaaag

SEQ ID NO: 69 - DNA, 3000 bp, Arabidopsis thaliana
ttcttcaatctctaacgcggagacataaccctaatattacggatggtttatactattaatcttcattaaaaatcgctaaaataggttataagatttccttaacaatgattataaagagcaggcagctatatttaagtatgtgtgatgttcctaataatttgcgattgataagaagaagatattaagatataatttcatgatgcttacattagatttagtccgtagctatatgtaattaataatattattgatttgaaagtgatgcatacgactattgctctcaatgcaaattaattattcacaaatcttgttattttcaataatttgaaggttttgatcaattattagtttataactatgtcattctctagctagtttatatagtcaaggtatgagatttttgcataactgtctatgtgaataatatgttcggcccatgaaattcaatatttagaaatcgtactatgtatgagtgaaggaaaataaatgaatttcttttcttaagtaagataatttaaatatataataatgatagtttaaaaaaaaaaaaaattaaaataacgtagagaacacgagtcgaaaaactagtggttcgtataagcggccaatggtcctcacatcatggcatcatgccatgcgaaaatataccaccaatctttagttttgttttcgtttaattattgaagccaactaagatataaacttttaggttttactcaatatatccgctatgagttgatcattttgaattggtttagtgttagaaatttttatataggaaaatacatgcaacaatctgaaaatgaaaatatcggttagacttagaatttatatcgttttttgggactgacttttgtttggcttgattagaatcacctaagttataacccaatgtgtatattcagaatctcacacaggaaagctagtaggtacaaaatatttgggaaacagagagcagcagcaatatattacaaaataaattaaacatacacacagtcacaaatttattggtggataatattattttttgtctataaagttatcataatgtttccacaattaatgttttctaatttcggcaaataccaaactccattattgccattcgaattaaatgcgctcccctttctctataatgcatagaaaattgacttttgataaaatttcccctttgaccttgcaatccaagggaaatggttggtctaatattttaactaaagtatttctcttcattttaaaatattttatcatcataagacatatcgaacgtacaaaacaattatttcagttatagagaaacttttatcgaaaacaaaaaaaaatgtatatatagagaaactggttttttttttccgttttttttgaaacaggattgagatttatagagatcaaagttaatcaaattgaaataaatattattgcgatgatcctctgacgacaatactataacaccactaatgttcaacatgaaaactcaaccatttataagttgggaaaataattcccttgaactgtcttagatttttaaagctaagtatatcgctcaaactagccgaaaagagttggaaaacctgaaaaactagtccaaagaaaaatcaggatggaagttgaaattgagaggtgcacacaaaaaaaaataaaaaaaattgaaattgagagggataaacgtgacgtggcatcttcatgctggcaacagctaatgtgaaaccttcccacaaagcttggagagcgacgctttttagtcgttcatcaatcctcaccccattgattgtgttactttcattatcacaaactgtttcctaattaaagtcctcttatttcgaatttatttcagtatagtacttgtgtgttaaacttaacaacgttgaaacaactatttccttcatttgcatttgaatgtacaatgaaactacatatttctacattttagtatgagtttttttagtttagtatatttaatgattatctttgtatacaattcaaatccaatatatataagaaactctcattattaatctcgaataagagtacgtacacattaaatcttatatgctaaaactaggtctcgttttagggatgtttataaccatctttgagattattgatgcatggttattggttagaaaaaatatacgcttgtttttctttcctaggttgattgactcatacatgtgtttcattgaggaaggaacttaacaaaactgcacttttttcaacgtcacagctactttaaaagtgatcaaagtatatcaagaaagcttaatataaagacatttgtttcaaggtttcgtaagtgcacaatatcaagaagacaaaaatgactaattttgttttcaggaagcatatatattacacgaacacaaatctatttttgtaatcaacaccgaccatggttcgatttacttgcttaaatatatgacatttgcacttttgagatgcatgttatttacaccttataaaacttacttgaactttaataatatttgaccatatatcatcttggaaatataaaatgtaaacacgaaacacaaaaggaagttttcgttgtatttgcatctatatttctatatttccaaagactaaaacactatcaatgtgttgtgttcaattttgaacgtttaacatgtaagcataaaaacaaactcagaaaaagaagaaaaaaagaagaaaaaaatcatcaaggcatgtctcgtatagctgccacaaacgtaaaaataaaataaaaagcatccataataatggataaaagcatcgtataaacgcaaaatctattagatttttgtttttatgggacacgtataccaattgataaacagaggacggcaccgaaccattttgacttccctcttcttctctccctataaatactttgtacttccccttacggaccctacgaccttttgtttctctcttctctattaatactatagttttcctcaaactctctgattagctcataaatactaaaccagttgaccatttttttctgataaacaatca

SEQ ID NO: 70 - DNA, 3000 bp, Arabidopsis thaliana
tggttctttatgatttccttgcttaattaagtttcaataagataagaaagtgttgttatgtgttgacaagttcagtttgtggtggcaggatgaagatgcattcttcagagactacgcggaatcgcacaagaaactctctgagcttggtttcaacccaaactcctcagcaggcaaagcagttgcagacagcacgattctggcacagagtgcgttcggggttgcagttgctgctgcggttgtggcatttggttacttttacgagatccggaagaggatgaagtaaacgaaataggaagtaaaacacgaagcaacgatgctcttatttgggtattaaagaaactattaatcgtctatcgaatctattttgctgctacaagattctaaactctttgaatccacgattctactgtttagtagtaaaaaagttaaaaagtcaatattttgggtccgtgattcatttttgcgatatttgttcattgcaatgttcgtttcacttattaattagtaccaaagaaaaagaaaaaagaaagaaacaaagatcggtcgatatctaccaaagtggggacataacctgaaacttgacctaacctggtagtggtaggtttagttaggtaggaaacttctactaagaaattaaaattaaatttttttttgctttcgtattttcattaaagaagataatatatgatgttggttgccagttacctaaatataggctcgggatgacatgtaatggacgcaaagtagcaaatagctttattcaagttgacataaaagaattgttgttacgtaaaagaagtgtactgtattttaacagaatgtgaaatcacctaacaataacttatataagaaactaaaagaaagaaacgcatgtcttctaaatttggcaagaacgaaggttttgtaacttgtaagtagtttaaataaataaaccatacatttttaataattaggaaatatatgttacatgttgcactttgtatacattctaaaagtcgtataatgtacctatttttttaagatttgtttggtgtgtgtgtagataacaaatcacatgtcaattctatcccatttctattttcttcgttattaaatatacaaatatgtcggtaggagttcagagtaaatgtacaccatgaaatctaccaaactcttttaagattgtctttcaggtatcaaacaaactttcaccaataaagctttttcccttttccaaataaagaactccaaacaagaataaaaaccacaatcattattcgatatgtttttatcgatacttatttcaaaatatccccttacctatttacaaaagcatttcacgaatgtttttcttagagtcgtcgtattttcatatatactgatattagcttaattagctcgtgatgacagcaaaattcttgaatattttgtaggccatggtctttgtaacttgtcaagaacatagatacgtcggataaattcatagatatcaattcaaatgataagctagcttacgaaaagcgtttctcaagaaactatgatttttttctaagaattagttggtcgttacgataaataagaaaccttgaattgatggaaaagaagataaggaattaattaagagattggtaaaatggtagttgagaaagtaaaaaggtcacgtgttagggcaaatcattaatggaagaaggagaaagcaggtagaaatgcactctccattttcattacattacaaactccacgtgaggtttcaccgattgtaggaactcctgattttgtgttaattactcacaagtaattatcatatagcgcgtagctaaatattagtataggatgtaggttttacttatataatgctatatctcactactttggtgaagagaaaatggatattaaaatttaaacggttgatacattatctgaatagttcttatatatacgaaacgatttgttgagatatgttttaacacttcttaaaggaagtaggataaagtggaaggtcacgaaccactccccatattgcagccaaatctacaccaaaccgtacccaaaaatgaaattaactttccctcaaaaccaaccttgtttgtgtcttctagattaatcctccaaacttttgattaaccaaaaaaattatcaaactaacatgttctccttttttctttagaaattctaacgaatttatctttatactgatttgaatatacttaatttggtcatttggatgccctttacaacctccttaccaaactcactatggcaaatatatactattttccattgtaacataaatgtccataatttgaattaaattcgttgcagtacgaaaccatccaactttgtccaaaaacaaaatccttataactatttactttaatgtaaatatatcctctacttttgtttttacaaccctagctcaaacaaatttattatttgcgatataaaatcatatcgaacaaactcgatgattttttttttcttacgttattaatgaaactaaaatatagaaaaaaacaagatgaaccaaattttcacctatctaactacttaaatataatatgattaaatttggtaaagtttgaaaagtttctttaggaaatgtgaaatattgatcacagtttctattgctaaaatcaccaacaaaacgcatgtcgccattcataattatggtttcacacctacaactaggctaataagtaaataagtagacaactagactcaggtttgaaaaaaccataaaagccatatagcgttttctcattgaaactgcgaacacgatcgtgtgaatgttgcagtttctagttttgatacaaacaaacaaaaacacaatttaatcttagattaaaaagaaaaaagagaacggagcccactagccactccttcaaacgtgtcttaccaactctcttctagaaacaaattaggcttcaccttcctcttccaacctctctctctctctctctttctcaaaccgtctctccataaagccctaatttcttcatcacaagaatcagaagaagaaag

SEQ ID NO: 71 - DNA, 3000 bp, Arabidopsis thaliana
acaccaaaatatatttttgttctctttaatttccttcaaaaagctaagtgtataactcaaaaaaataaaaaagtcaaaagtcaaatttgtgttttttacaaatgataaaaattctaaatttcttaactaaacactaaaccaaagtatttttagttttccaaacacaagttataaaggagttaagaatggtaaattactaattagtgaagaatatataaaaaagggtgggtgggtgaccggcaggtgggagagtggccgttaaagggaggcagagatttacagcctgtttttgttttttttataatatcagaaaattaaagtggtaacgatcagccttccgatctatccttgtcgttttgcgccacgtgagcaactgtctctttttggcctatctttttctttttgttttgctttttttcttctttgctttttagagtatttcatttttgagatcggcaaaatatccaaaacataataatgataacaatttttcaaataaataaaaaaaatactaataatggtatacaggctggcttcctcagtcaaaaagtcaccgaatcgaaccaaaacctcatacctaaccgttaacttcatccttatcttcttcttcttgttttccttatttctttttgttggtgctcttttttcatttttctattatatcatacattcttttaccatattacttcaattattgttggtttaccttcataagtttaatatgttttagtgcatacgatatcaactgttttgcgcaaagggttgagtttttatataaactaaacgaaaacaaaatttggagggtactgaaattgttcatttttcattatcttggtgtaaataatctatgaatctcatgtgtatatgcaaagtcatatgaagtgaacttggtttagatatttgttgtattttcaattttcatttttaattatatcatacattcttttacaataatcttcaattattgtttacatccctaattttaatgcataagatataaattgttttgagcattagggtttagtttttttataaactatatgaaaacaaaatttggagggtatttaagttattcattttcattattttgtgtaattaatctatgaacttcgtgtgtatatatgcaaagttgcatgaagtggaacttggttttagatatttatgaatatctagatatttgttgtatttcagtttgttaggttttgttctctctttctgccaattacacacacttttgttttacaaagaacataaataaaagttacatatatatcctgaaaagtttgcttcactgtatatatatcatcatcctacacgcgcttcaccggcgtttaccctttcaatttctggttaactaagttgaaccggattagtaattcttcggtttagttgttcttctatacgacaatttatcacttgacaaatataaacgatctattacttgcaacattcatatttaatctagtatcttacacgtacatatttgttagaaattcaatgaccaaacattgcaaaactattacattcacttgttgcatgtaagctagaagcctagaactcgctgtcaacgactacaatgtctacattattttcaccgacacaatttacatcttaaccaaaatttggatattggaccaatcgttcgtttatataataaccacacgtatcaatcaacacacagaagacaatgacatgtaacaaacagtgtaaaatattgaaaataacttatcaaaaaactttagttcataacacaaaaactttcggctattttttattgacttctatgtagtctttttgttgcacttactatttttaaaagcaatatgtatgtttccagcagattcttagtttttacaaaattttgcctttaatattttttttgatatacattgccattcttgatttcattttcttctacaatagtatcaaaattttacaaaataaaacttcaaaaaacatacgaaaaagttaacaaatattcaaaaagagaatgattttaaaaaggatataaatatagagagaataaaacgtagaagttaacgatttttttttgtgagtgtcactttagatggaaaatgaaatgattgggtaaaaacgctccacctgtaaaacagagagtggaagaaacgctcctgtgtacgagcgtactctctcttcaaaagaaaacaaatctctcaaaaaaaagaaagaacaattgaaaaaaaaaaagcaaatctcaaactcaaagtacatatacttacttgacacgtgttaatatacagctgtatcccaagtccccaaccgtttttcctggaagattctctgctctccacgctcgatgttaacctcacacaaacgcttatctcccaaaacgccttttccaatcgccaacgtgttttatttttggtttaaaataaatatctgttccaatcatacaaacacgtaaatgttgtcaatttttttatacccaaacgttaacgaggtttgtacgtagcccatttatggacacataattatgaacatataaacaatggttaatcatacgtttaaattaattaaattcaccaatatttttttgactgaatgagtcaaaattgtttaacgagtaacgaccataattatcagtttttattttttattgtttgaactaccatagttatccgtttaacactgagcaaatctctttattaatagagaaaacggttttatttgtttccttctataaaatttgtttttaataatacgttagatatttttatgcagttaaggataatattacactgtaaagtttaactagtttaatatcgtttctgttaaatcgataagaaaaaattaccggttgaaccggtgacccttttgcccactcctttctcgtataaatactctctcttcttgctcttatcctcttcaaccaaaaagcttttcttcccaacacacacaaaaaaaaaaactgtaacgaccaaaaaaaaagaggacgcgttagaagaaaaaaaaagaacaatccgataaaaagatccggcg

SEQ ID NO: 72 - DNA, 3000 bp, Arabidopsis thaliana
aaagctttacaagcttccatataattcgacggtgcaagttgttttgcaagacaccggaaatgtagcgccggagaatcatccgattcatctacatggatttaatttctttgtggttggtttaggaactggaaactataattccaagaaagattctaacaagtttaatcttgttgatccggtggagagaaataccgtcggtgtaccttccggtggttgggcggcgatcagattccgagcagataatccaggtttttatcttattatactagtacataatatctacaacttttgtatagtaatatatatttttcaatttgtaacaatgactatttgaaataatatatatgtatatttgtgtggtttcaggggtttggtttatgcattgccatttagaggtacatacaacatggggactaaaaatggctttcttggtggagaatggtaaaggccctaaccaatcaattcgtcctcctccaagtgatcttcccaaatgttgaaaactccattattattttttgaatcgattaattcgtttcttgacattttaaaattttgatatgtgtatgctcatgtaaattgtcaataaagtcattgtatgatttgttacgctttaatgaaaggttgaaaagaagcatccttttaattaaactcaccaacttttttttgagctgaaatttttttcggacttctgattgatccatagtttgtcctaatttgtttttatcacttgtttaatacatgtggtagataataaaaaatgttcaaaacgcaataccatacttgaaaaaaaaaaatgttagacctagttataagacaagactgaactaattaagtgatcggttagttggtaaaacaaaatagtatttcgaacttaattttcacctaaagtttaaacgtgtctactaatgactcgataaactaaaaaaaacagtcttttttttcttccaaaaagtcgttatcaaagcagaattcatctgtcgtcgaattttgaatgagtaggtgcaatgtcacatttccaatattaaaagaaaacgagaaagaaaaaaacaaaatactcctcataaaacgatagaaatgaaataaaacgaagcaagagtaataaattcgacagaaaaaggagtaatttactaattatagtaagagaatcttgctaaatatagaatccaagaagaagtcactctctgtggaacagaaaccttgtgtctgctacaaatcagcagatgacacttacagtttacgtttcatcatgcatgtgagcgacactatagggagaattcggtattggcttcctttgttgtccctaccttatttaattactcctgataactatttttctgtgtatttcatcgtatcgaaatatccaaatttcattcttcatggctgatttaactagtgtttaattataattatactttatacttttttttggttcttaatcacacatgctttcgggatcttgaatacgaaattttaaaccgtctatcatttgtttcctgaaccgggtattgcaaatagttaaatcttagtcaactattttttcgagttttttttaaaaatagttctgaaagacaaaaatacatgagtttgtgaaaatgtttgacagttggctataataattggttgcaatgctttatacttttaccaaatttaaattattcaattggctagaagtggagctgtggtaccgtccacatgaggtggtgtcgtggtgagacattaatatatgaacttttgttacgatatgaaagcacccgacacatacattcttcgtattatcttgccttatatgaataaacataaaataaccaatactaaatttgaaactgtgatacactaaagaaaatatctttggttacatccagctctggcttctgttcaaagtttttcttttgaatttatttaaaggttaattaagatcaccacctaacccacttgtacaacggttctgcagtttttgccatcgaatcccattgtttaattcgcatatttgtatgatctctactttttttttaaagttaaatagattaattaacaaaatgaagtttatttacaacaaaataaatgaaaagtacaaatacgttaaaaaacaaattgtttgccagccaaaaattaattaaatacgtaattttcgaaggtgtaatattccaacttgtttttgtatatttgtttagcttatggagttatggttgtgttattatatattgaatgggctatttcgtgttgacaaataagctctttagttaaatattattatgttcttgattaaacaacaaattaagaaccggccaaaccattgaacagtcgttttctggtctttttcattttattggttacaccttctttgtcataaaatagaaattatgttatactttctttcatgtatcgacacgtgcatttggttagtcttaatcccatttcaattttatatgatttatcatattagcagaaaacaaatatgctaattatcacatagataagccatactaaaagtatttatctgaccttaggttaaaaaaaatattaaaatatagcttataagaaacattcactactgagttgtcatatttctactggccgacttagattgcaacaactaaaatatattttttataaatcatttgacataggcaaaacaaaaacaaatatctctgtaactttttcctcaattttttcttttaaaaaaacacttttttatacaccttttcctgttgaatgtattattattcctattgatcatcacgtgaaatatagaaaaataaaataaaaaagcaaaatccacttttgtgttttccttttcgtttacgaccaaagagatccactttatgctctcttcattttctccatgtaataatttttctcgagagatttctgaaaataaagtcgtttctttttttttttgccttggtcactcaagactctcttcttcactctctgttttttgtcctcttctaaaatttagagaaaaaaacgaaagttttcaccaaaaacagaggaggagct

SEQ ID NO: 73 - DNA, 3000 bp, Arabidopsis thaliana
cttacgtgtctttaatattattgtatataaatggaagggtgagaaggagacgagaaatatcacaactacccaaaatcatctttgtaggctagctagcaagcagccatgaattcaaattcagtcggtgtatttcgtgagaaggaaatcgatgggaaaccattccacacatacactttatcatctcaaacagacaccacaaccccttcttcttccggtgaaacagccattgatggcgacgaccatctctctcttcaacaacctcttttcctctgtccttctttacgtcttaaagctgacgagataaactattcttatagtgaaattctaccgttcaatatttccccgtacttccccagcataagaggcgctgatcaacaagtccagcatttgcttgattccgacagccaacaagtccatgatttgcttcattccgacaacagccatgatgatgatggtgatgaaatctgtaagctcccagttgtccctatctattggtgtaacagtaaagaaattgagttcgatcaattcaattgcggtgcatgtgaacgatcaaagattggcacagactattatatctgtctcacgtgtgatctaatgttccacaaagaatgcgtggagtctccccttgagatcaaacacccttcctatccctttctttcactcaaactttacactcgtcacgagcagctcatgagttgcatgtgctgtaaacacccttccaatcttattttttattattgtcccacctacaaattgagtttgcatcccgattgtgcgatgaagccaatatccatttttatagaccacccaaaaaggcatccccaccttctcaccttttttcccaaacaagcttccttactttgcgatgtttgtagcctcattaaagaagctttccccacctatgtgtgtcttcgatgtatctttgtagcccatcgagattgtatctatttcccgtatgtcattaaaatatgtcgtcaccaacaccgtatctcttttacctcttctcttccatctggaaaatggtcttgtggagtatgtcgtaaaaaggttgacaacaattgtggtgcatacacttgcaacaagtgtagccactattttgttcatacaagatgtgcgttacgggaagacttgtgggatggaaaggatctcgagggagtacctgaagaacctgaaataattctcgagccatttgagacgatagctgatggaataatactccatttttctcatggccatcatctgaaactcaagaccagtggagtttacaacgaaaacattatttgtcaagcgtgcatccttccaatctatgagggtaattattactcgtgtatggatcaatgcaacttcatcctccacgaagcatgtgcaaatgcttctcgcaagaaagatcatgccttacacagtcacccacttacgctaaaagttgtctctgatatacagaatgaatactttaaaggttacttcaggtgttccgcttgtgatcgtgaaagttgtggcttcatctatgaggaggatcaatacagcatagacatacggtgtgcctctgtttctgaaccatttgattatcaaggccatgagcatcccttattccaagctttagaccgaaaagaagaaagggaggcaatttgtcaaatttgccgaaaaaagtatggtcgaaaactaaattgcatcgaatgcaattatattatatgtttcagttgtgctactttaccatacaaggcaaagtataagcttgacaaacatttcctcacatttcgggaaggggaagagggaagtgatcagttagactggtgtgaggtatgcgaaaagaaattagaatactcaagagaaggtgggttctatgcgtgtgatgactgctgcaccactctccatgttgattgtttgcttggaaaagagatgtatatgttgaatcctggtcatactgtaatggcttataggtcaaacatttatattcttcccaacaataccatgactcgaccattctgccaacttcataaagaagatcgttgtccacacaaagtaattttcaattggcatgacatgacattttgctcttacagttgttcgatggattagatgtcatcatcgccggtgcttcgtcgtcccttattcgctatatttcactccccatttgcttgtctacgttttgtaatatgtttcttctattaaaacgtattgtaatacttttggattcttaacttcttctagttccccatttgctcaatcttcttgttgtctggttgtttacgtttttgtgtaatcttttcttttactaaaacgaattgtaattttctatatcttcttcttacccaaaaacctcgactgattaattatatctcggcctttgggctttaaattatgggccaattcggactgttctcgcttaagaaactacagtaaaaaaaaaaaccagaatgagttatcttaatgatccgacggtccataatcattgaggacctctgatttgccgacgtgtacaatggtcaacgcatcagctaaagagtgccgtttgaggttgaaacttttatttccaacgtcaacctttcttctacttttaacgtccgttaagtccccctgtggtttcttgtcaccattttcggttatagtttgattttagataaccggttttatccaaccacgaattaaactcgttgttttcgtttttatccgaaagaatattataattaattaattagcccagtcacattaataagtttcgtaaaaaaacattcattttctcaattcaattaaccggcttcttccaattcttttgagtcggtttggaataaaccggccggttccaggttaacggcagttagcagttacgtcggcggaagaagtattcgttacaatatttgttttaatcccaattagtctccttctcctttctctcttctctctcgttcaacgggcaaagtttttttcgaatataagttttggtttgttttttaacgttcccttcttcttcttcctcgcgaattcgcttatctggcgatcacg

SEQ ID NO: 74 - DNA, 3000 bp, Arabidopsis thaliana
ttagactcgacgctttaagatgaagaagaagcaatggattgactgattttattttcatgggtcgaactcggagcctttgatgctgttcactgaaatccaaaatccaaaatcaccaacaccaccaactaaccgcatgtgtatatgtaatccaaaatcaacactatttttaccacaccaaaactcactataaggttaattcgaatagaactcatctaaccatctatgaaacttgattaaaaagtgttgtagaatgatttgtgtatgtttatgtaaaagttctatcgctcccaatcatacccgtaactggatacacgttgcaattgatctttttattttttggttggccgcgcactgcattgaattaacactaccttatccaaacaaatagtattaaatatctacttcaatcgaacactcttaagcctctctttgttcacaataatgataattagattagtgtcagcaacgttgacacatattcgtatctacaacacacatacgcatacatttatatataaattaatttcgacaagaataaattatgacttgtatggtcaccaataagtctcacatttttgggtacacaaaagagtaataatgaaataaataaaaaagataatgtggagtggtttatacagtgagtgggatggtcaaatctgaattttagataagatgcaaaattcaggttgcctcaatccgaccacgtctcacacgccctgtgccagacctgcccatctctgttttccctatagtatttttttctaattgaaaaatacaaaaattccattctccatatatttgaagttatataaaatccgtggcaaaatatgtgatttgacttttgagtgccaatccgatatgtgagccgttttgtaaacacaatttttggtttcagtaaaagcaagatattaggatctgatttcatatataaatttttgaagataccttattatatcacccaaaaaaaaagctgtgtattcaagaaagtgtagtattttaaaaataaatatgtaaaatgttcatgagtgagactccctactagtttaagattgtcaaattcacctagttaaagttggatcacttatttatccataaatagataacttaagagattgtcaaattctatttaaagagtctatctaaaaggcccattctcttttttacataaaccaaaaccgctcattaactattttgatcagtccagtccaatagtttgtgttttccttgtttttgggctactagcccatacacatttccaaaaaaaaaaaaaaaacttttttttccccctattttactacatttttgttaatttaatgtttgattcaaaatttacctcaccaatttatcccctcttctaatttcctttctatgtatttttttcaattcagaaatttcataccttctttttatcatccaataatcgccccatatttttcatactcacagttattttttttgatttttctgtatttattttcccatatttttgaagataatatcaaaacttgaaacatatggtagcagataaaaagcttaaaatagcaagagcttagtagattttatttggaaattggaaagccaggtgacgattaaacaagaggccacgtcatgtagatgcaccagtccgatgccaaaaagtatcctcgcaaaacaattggcagaagacacgtggctcaatactggtgaagagtcggtcttggcgtcttggtcgacttcgtaacgtatccacttcatatttgcaatccaattaatttagtaaaaagtgtgtaaaccatttttaaaaacaagtaaagtaaactacgtgtgaagaaagaaacaagtacggctaaaaaaatactaaaaaaattagttgaagttgctttgttttcttttgttgaaggtcgttgagaacatagtttaataaatacaatgaaactcttccgataagataagacaaatttcggtgttatctttctctacaggagtatttaataaaaagtataaatcgaactattttataacacgttcgaaatcaaatatactcatgttttccacttcccacgtttacgctgacaatctaacattatgtgtttcaacaagtaataatgtaacactcaccaaggcatgaactgatggaagtgctatgaatagaatatgattgattgtagtgtgtgtttggagcttttactggtcaatacacttaaaacagttgaggattggattttttgactaacattaatgacccaactgtcaaaaattagtcaaactttgcggtacataatttaattaacacgtcaaatgttggaccatcactataaaaaaaaatatttgttcatcatgagaatcgtccttggcccaaaaaaaaatccgaaaacataacaagaattataaggttagtaaaatgaaaaaatcataaacagatggaaaatcacagataaccataattacgaaagtgaagttgagagaggattggacaaaaatagtgacaaggaagacgtagacagtgcagtgctgtgattgattcgagaatgtgaaacctaaataaaacaagtctttctagattgctttttcgtatttttaggcggttggtttttttttttttttttaaatagctacgtgttcccattttattggaaaaacaaagtggcatttccttttaaataaaaatttttaaagataaaaagggagaaactgtaacaaactggtagcaaaaaatcagtaagtcaggtcaggtgttaaccctaaaattaaaattgaaaataaaactgagagaaagagagagacaaaagacatcccaattgcagagaaaccgtgttgaagttggtctctgagctgcttcttccttcccttttttatttttatttttccagctctttattttcttatttacaaaaaactttcccaagaataaaaaccagaagaatccgtataaattatcctaacagtttcttccaatatccaacaaatttcagatttttgtttttgttttcttcttctctacttgagtaatcatcaacgatt

SEQ ID NO: 75 - DNA, 3000 bp, Arabidopsis thaliana
tttgattcaggaaaccaatgtggaccaatctgttttcaacagtgtggctaacttgtttgtggatcggagacctcaactaggtctaggacgacatattatctcggattctccaactttcctatctttatgtgaggtaagtactaaagacaacataacgttaggaattcttttaggttgttttataatttatgaaagcgttactatcatttttctaatctgaatgattgcatatgttatgtacatgtaggagcaagttcatgcaccagttccatcgaactacaacggtcataaccagcggctacatgtgcagccgttaccagttatcttccacgatggacgacttgtgaagctaccaacaccagccaccgcactcatcatccttctttggatcccctttggaataattctagccatgattcggatattcgttgggttcttacttccattatgggccataccttacgtctcacggatattcaacactcgattcatcgtaaaaggaaagcctccggcacaagcaaccaccggaaacccaggcgtactattcgtatgcactcatagaactctaatggatccggtcgtattatcctatgtgctcggacgtagcattccagctgttacctactctatttctcgtttatccgagatcctatctccgattccaacctttaggttaactagaattcgagatgtagatgcggagatgatcaagaaagaactgtctaatggggacttagtggtatatcccgagggaaccacttgtcgcgagccgtttttgctgagatttagcgcgcttttcgcagaattaaccgacaatattgtgcccgtggcaatgaactacagagttggattctttcatgcgactaccgctagaggctggaaaggtttggacccgatcttctttttcatgaacccgagaccggtttatgaggtgacgttcttgaaccagctcgaggtggaggcgacgtgttcgtcagggaagagcccttatgacgtggctaactatgtacagagaatcttggcagctacgttaggctttgagtgtactaactttacgaggaaggataagtatagagttctcgcagggaacgacggaaccgtgtcgtatttgtcgtttctcgatcaagtcaagaaggtcgtcaccactttcaaaccttttttgcattaatttacaagttattttgataattatatactctaaattacgcgatcactgattgcttaagttttcatttttaaagatttttttgttgaaagtatattatgactacggttttgtgttttttttttccttactttataaattgtcgaatgtaatcgcaagtatattaacctttttgttaaaagttgaaattaaatacatgacaacgtttttacatatctttcaaaagagagcccaatagaataatttccttgggacattttcgctttatgaaaatacgttgacaaaattgtccaaatattctatatatctaactacttgttagttaaatttggttatgtttaatttacatcacatcttaaaagaatgtatagaattgttttcaatcatacaaactaagggtgagaaaaataatggttggtaatgcacagacgattaatagtttggtggtggtagctaagaaattgattaaggaaacttgagctgcaaatatcatcttataacttttttgatcaaataatagttaattgcgtatttggttggatgatgacaatctctttgaccgccaaatttttagctgccgccttcccgttagagttggccaacttttagattcgccacattaacaaaatagttaatagtacatgcttcagaaaacagttaacattataaaattttctagattaattaggttaataatactaaagaaaaatgttttatttgtttgttttattcttaagaagaagaaacgtaatgggctttagtatctctaacttgaattctgttgtgggcttttctttaggatcagaagtaggtttcgtaagcctagtgttgtccttatacgggaatatacatacgtataaacatacgacacaacatgaaatgagataaagagagtgaccaaaaaaggctgcaaaaaggtgaccaattcaactctatttctttcttacaagttacaactctttcaaatcaattattcaatctcactcttttactatctgaatgcatttcagttaataaaccaaaaggattgtcttcataagctgcttttatttttgcttaagctttgatttagtaaaaactctgattaatttttagtaacataattacaatgctaataacaataataaaatagttaattttcacaagttatcgtattataatatatttaagaaaacgttttagaaaaagaaaaatgggatagaaagtagaaaagagtaaaaggaagagaaagagctaagcttctctccctccttccatttccactcgatgttcagctgcccaagctaagctcggatctctatccagctttggtattttccttagccttgagcttctctccgcgtaaatataattttttgtttctagattatctttccgtttctatctcgaattgctgcttttcatggatctatgattgattagtccttaggatctttaaaaactttcaatttcagcttagatttcaaatcaggttttctgttttttcatattcataatctgatagtatcttctttgtgcgttctgatctatttcagctgatctttatctgcgctttcgattgatgtttgcatcagctttgttgttgatcttcttcgtaatagactactaatcttctcaatctaatttttattctctgttggttttcaggtatccagcgtctgacagttctggattttgttttttttttctttccttatttagggtttgttttcctctttcgtctcttttaattctttatgactatgaactttctttatttcaagctgaagtttttggtgtttaggtgggagcttgatgtctaaattgttactgtcagtggtttaattagaaaagag

SEQ ID NO: 76 - DNA, 3000 bp, Arabidopsis thaliana
ttgaatctagagaaggctagaagagaagcgtatgcagctggtctcttggggaagaatgcatgtggttctggttatgattttgaagtttatatccactttggtgctggtgcgtacatttgtggtgaagagactgcgcttcttgaaagccttgaagggaagcaaggaaaacctaggttgaagcctccgttccctgctaatgctggtttatatggttgtcccacaactgttaccaatgtggaaacagtggctgtttcgcctaccattttaaggcgtggacctgagtggttttctagtttcggtaggaagaataacgctgggacaaagctcttttgtatatcaggccatgtaaacaagccatgcacggtggaagaggagatgagtatacctctcaaggaactgattgagaggcattgtggaggtgttaggggtggatgggacaatctacttgctatcatccctggtggttcatctgttcctctgatccctaagaacatttgcgaggatgtgctgatggatttcgatgcgctcaaggctgtccaatcagggttaggaactgcagcagtcattgtgatggataaatcaaccgatgttgtggatgcaattgcaaggctctcttacttctacaagcatgaaagctgtgggcagtgcactccttgcagagagggaacaggttggctttggatgatcatggagagaatgaaagttggcaatgcaaagctggaagagattgatatgctgcaggaggtaaccaaacagatcgaaggacacacaatctgtgcattgggtgatgcagctgcatggcctgtgcaaggtctgataagacactttaggccagagctcgagagaaggatcagggaacgcgctgaaagggagttgctacaggctgctgcttaagtaccttgttaaccagaggtttgcatctccagtccttgctcttttaatcttctgttgcaaacttaaaagctgaggtctagagtttacgcagccttttagaatgtatttgtgacaaggtagactgctctgtatctaatttctttgggcatttcaagaacttgagccgtaatgaacagttagtttccgtaactatctttctgctctatccctgtcttacaaaattgatgtttttgcagggagtttgctattattctccatggaaataaaatctgaatgaacaactagtaacggttttgggatgcaaagctacttcagaaggagaagaaggtaatgtaatttgtttgaatggttaatgttaaaactctcttaaagttgtatcagaaagagcgcgatttgctcttttgcattactctactttctttattgtttgcttgttatgtttattcgagtatgaaagcacattttgggaacaaccaaagaaacccttttcatgtttgaaataaagaatgctcctttttgggtttataagtagttcacatagcaaataaattataaatcaatgtttctttttggcattttctgaaaaatatctctaggatataaattggtatatcattgttctgtatacaacttgatatgatagtccaaaattagtttttttggataatgtataaccaaaatgtgattagtcccaacttgatttcgtaaaatcaaacaaagtagaaatcatcttaaaactataaactagaaatttctaaatggaataacttaaagaataaaatgaaatggaagtgatatatatattcgcattgaaatggagaaagagagaaaaaggaaaagagataaatgaaggcaaggaagacctgtgagggtgatggggaccggtctgattggatattatttttggaggatatttatggataagacgtcaacatcttccctaacttctttgtccacctctcccacctttttccccccttttccaatttctttacttaatcgatagaactactgaatcaacaagttgttgtatgatgaaattacataatcacatatttgcataactcggaaagtcgtcatataggcaattagcatctttgttgttttcgattttcgatatgagcttaagtttgaacaatgtttacaaatagtttgatatagtatttcattgccttttataatcaccgtacaaataattattattcatcaatgattgcctccccaaatgtcaccaaaagaaaaatctagtcacatgcgaaagcattatgaaagtgaaaaaagaaaaaactgatatgaaattaccaacgatgaggagtagcagtaataaaatacatatggcataatttggtcaacaaggaaattccaatatgaattggaagtgtaacaaataataaaagagtcaacaataccaaaaataacaacagcggacttgagctgtgaaaactgttgcttatggtttttattcactgtttctttgttttgaacttccccttcctttaacaatggcgttttgacccctccctatctctctctctctctctctcagtcttctgggtttttcctattcctctttctctctctctccttcaagttgctgcaatcccttgaaaacccaataaacccccaattttccatttctcataaagttcacatttttccttcttcttcttctgccaattctctgattccctcgtttcaatctccgttttgctttgcctatcagataaatttcttcttgctttcctttctatctcataacgataagttgaattaatctttgcgtcttagttcatcagtagagagagtagggttttttccgcttatttttagggaatttcattttgttggaggtgagaatctctattcgagtccccaagattctctttatatccctagtttagttgtatggttgggttttgattggaatatcaaggggtagtttttagctaggttcactgatacttggaagatctgagttctttgggattctgttaagtttgtggagatctaaaagacacgaaatttgtagaaatctggttgatatcccagacttttagagggattagggtagattctatagaatttgaggcgggtttgattggaatt

SEQ ID NO: 77 - DNA, 3000 bp, Arabidopsis thaliana
attgagattatataaactttggcttaaaaataaatggatggtggtgaagaaaagggaaaatatcacaatggttgtcacgtgtcacttcacacaatccagtagaccagtacctaacatccagcaccaccaagcctaaccataaactcctcaaatgacctaaaaggtttttttaacacttcgtttcgacacctgaattgttatctgttattttatctttttcacgtcttacgcctcctaaatcctaatcgcttaaatattttttgaacatgttctcatctgtttttaaaaaatttggattttcttttcactaatgattgttacattagataaatgtgatttccactacaggtttggattttattgcattagaaaatatggtaataacaaatatttttataagagatgacaaaaacaaatactctaagtagacaacagccacacaccaaccactttctgatatttgaaaccctaagtaaagaacgagaaggaattcttgtggctgagaaattttgttgtattatcagtgaacgtgaataaaatgaataagaaacaaataaaaagaaaactagtggctagaaccctccttctcgtcattccacatgtcaagtttctgtagaacagacggctaaaataagaatcagtgacatggagaaaagtgcactgacattcactaattattagtattagtactatattataaattaaagtgtaattactttcacttccaccgaggatgacttttacaatttgaggagtatattaaattatgtgcttaacaatgatttcaataaaatatctacacatttgtgaaaattgatgacgacctggacgatggataatcatattaattcgagaaagttgaaactaattataaatatcatagatagattcgtatctgtatatattatattatatggtatgtatacgtagacttacgttatggatagacccccaccatgtttttatatagaggcagaagatatttaacttatggttttcgttttttcgtaaaatatgaaacaaagacaacgacaaaacgaaaaagaaccaaaaatagtatctcattctactttcacttgattttggaatttcatttatttagattgtgattcaaaaccatttcaactatgtaaaattctgtgcaatatttttcccaactaaacatataagtttgacatgaaaaagaatataggaaaatttagaggtccaaattttatatgtatatcggaatcatggtaggatacgttatcaattgcatttgtatgaggcttgctattgctagtatagaagcatcatcaacaaatcttaatatcagtccaaatttgaataacccattttgtggatctcatttcataaaataaaccattttagtgtcctgcaaaaatgtgtttagacagaaatcttttttaaaatctgaatttagatattatgatggttataatttatatataaatttactatcaaatattgtgttcatatatggaagaatggagaaaaaagagtagaaccccacaaaataaaaaatggatagactatgttttctaagattggacaaagtgtataataaaatcttctgatctggtccaaaaataaaatgttaagagttttcgaattcgaataatttgattttgattaagatatccacttcggatatgttttcatatgtagctttttaaaataccctaataaatattttcataaagagtttatgtaaataaatcaaaatatatttttaactttttatttattatagttttatatattactgttttaattattttgaagtatttttgatagatatggatttggatggttccgcaaacaaatcctatggatccggatccaaagaaccaatcataaattttggaatatgtccacccatatatggatcaatagagatatagttaagaaaagaaaatgaatttatcccgcaaatttacatttttatctcatgtagtggaaccaatgaaaagcgagtaagctaagaagtcatactctcgagagtacgcctttccatattttcctttaaaagtatcttctggtggctcacatttctccgtccagcaaaatcttttttgttacataaatattatatttcctgatattttatattaaaagattatccaattgaaatgatgtcaaaaaaggaaaggaaaagtaggggaattaaataaatacatacagtgataatcgaagtaccaaatctaactgttttaaaacaagtagattcattttaaaaaattaaatatttgatttttcaaagagataaatgaataaatctagtacaaattttgttgcaaaaaaagaagatgaagaatatgagaaagagcgacacgtggcaaagatggacattgaacgtgagccacaagattttccatctgtttctcgagcgttccatggaaaaccaataagaattattatttttattttttaaaaattgggaaaaagcgcacatagcagaagctgacgtggcatcaccctcctttttgtcttccctattttctcacccccctaattcccttcttcctccttcacagaccccaaactcttctcttcttcttctttctctctgttttcttcttcttccgccgaatcagaaagcttgtctttttctttactccggctaccaaaacttctcggagtttctctgagagtttcatttccgaccttcttcttatccttatttgcggcaagatttccagcgagagtttttttctcttttcctttatcgaacataagaaatctctggtttgctggaagttttttttccggaaggtggaagcttagattggttctgatttcagaagcaaatcgtttgttgttgcctaagtaaaccgaatcaatttatgggatctatagaaacagacggagaacagaggaaattaagctgattttttcaagtctagattcgcgaatttatcttggtgtttccttttctgtgttccacacctttcgagtttttttttgttttcctccgccgagatcttaatccgggaagtt

SEQ ID NO: 78 - DNA, 3000 bp, Arabidopsis thaliana
tgaagaaaaaaaaaacatgaactcgatagcttaaaacaccgaaaaaaaacgagtgggcaacaaatttttggtaataaaaaaataatcgagtggcgtagaataacaaaccatccatatccctatccttctctctattacctaaacacaacgacacgtgtctgacttttggaacatctcagaggacaacacttttgtgctgactaggcaataaagtgcaaaacaaaagtgttgttttttttctcctctttcattttgagacagttgtaccaaacaatttctaatttggataaatggttttttttttcattgaagacttccagatatttattttacaatttttgtccttcacataaaatacctatttaattttgttttgaagttgacggctactgaaatttaaatatctctttcttctttttaaacaacgctcgtgtatgtttttatttagctactcgctttctttgccacatacttgggtcaaaagagagcactccaaaaatatatgatctgtcatttgaaacctaactattcctgataagtctaggttcatagtctaaagttcttggccctcatttaggtataaatagtctaaatttaaagtatttaagcaaaaacaatactgagaagaaaaaaaaaaaaaaaaaaaaaactacggtaaaatttctagaaatgtttaagaaaaatctaactaaaatcaaaagaatagcgtattaaaatactaattttattggattaacttaatttgatgaaaatgtctcttaatatttatggcgatatgtatgttggttggactttgaaattgtttttatagatttaataagatgaacattttgttcttgcttgagagtggctgggtacacaatttttttcactttgttcatgctaaaattcagttttgtcttcttatatttacatctaagtttatgtttgattatctgaaacccaaattatcaagtattttacgattttttgaaataaacgaaatctgtttatttccttattcaaattttataaaattttgtaagagtgatttgattgaaaatggacaacatttggagacattttcaaaaaaaaatgttataaaaggttattttaaaatgctttcaaaaatatcaatataataaagagcgtgattatattttaattcagaattatttaagtgatcgaaaatatcataaattttgtataattagagcatttgttctgatatgcgacatattttactataattttataggaaccatataaatttaattttttaactaattccagttgcacatttgtttagatgaaaatgatttgattgctgcatgatataatttatttacatttaagcatatattttattctattttgatgaattgtgtggtattttcgtacttaaattttgatatattgtatgtaattgtacaacatactcaatcatatgttattacttctaataatttgaatatggacatactcagaaaggtatcaagggctctttctctagctattgtttctcatataatcttttcaaaatcatatatcatcaccaactatactcatcattctcgggtactatgagctctaactagtggaatggtactagaactttgacacaccgtctagttgagattatagaaattaaagattatgttatatatagtagaaacaaagtaggccaaattcttatagaaaagaataaacaaaattaatataaaagataaatgaaaaaacggtcttgaattataaacaatttgctaggtgtgattcaacattgtctttattcaatacttgttgggtcataaacattcaaattgcatattattgttactctagtattcaaattgcatattatgttttatctaaactaacttatatatttattttgataaacatgtcatatgatattaaacttattttcaattgatcatcttctaagttgatgcattttagtattttatattcaaattttgagatcttagtatgtaatatattttcaggtttttactattcatcagtttgatgatgcaaatatacatagtacgaataaaatgagtgaaattgtttaattatatgatcaggaagaaaaaataatattccaaaatccaaattttagtgggtaattcttagcacaaaaacaaattttgtttccaaatatatcacatatttttcaatgttccacaaatagcattaattgttgaaatttgttatgaataagaatatgttctataacattatatgaattagaattatcaatagataaagtgtgtcaactcaaatcgctaaattgttgaaaacaatttaataatatattcatttaatatattctcatgtcaatatgatatgattagatctatttagtgagatcttatttaattgttaattctaataaaacaaaaatagtgattatattactaataaataatataattgtttaatcttattttatggaactgtatttctcaacttcaattaaatactgtacctaaacctaaaattaaatatgcaatcaacttgattaataaaaaacaacaaaatggggtaagaagtaaacaacgttgttaaacaagacacgcgctcaccagtcgcgagtttggcaataatcatgaaatgagcttctttaaaaaaactttctagtagataaattaaacaattaaaaatctccgacaagatttaacaaagaacagataatatcttctccgcaaagacaaaagtgaaagcgaagaagaaatcctccacgtgtcattagcatcttttaacctgagccacatgatactagtttctcgaaacccctctttacgctttttcacccaaatttttataaaaagaaaaacattatgcttacgtggcttatcttcttcttgctcttttaaagtaaccccttgactctgctcctttcataaacaacaactctctcaccaatctcaaaacaattctctctctctttattcttcttcttcagcttcagatttcagatcttaaatcttcaagtcttcttcttcttcttctgcaacc

SEQ ID NO: 79 - DNA, 3000 bp, Arabidopsis thaliana
gattaagcatcaattgtaaaaaacgatttaataggttacttaatttgtcaaagtcccacatcgctcccatgaaaaaaagagacaactatttttattgtatacaaagtgtaaagtttaataagcaactatttctactaaacaaatataatcgttacttttatattaattaataaaattaaataaatttgtttactaaatatatatttaatatgattttacaaattttaacattagttatttataattgatataaacacttaacattacttattattaccataacaattattaacgttattttgataaattgatgcaaatactaatatcatttatattatttgtgtaaaattaacatcattgtttgcaattaatgcaaaattatttgaaacgatgcacataatttgcatcaccaatttcagagtcacttataaaagtgatataaaactcatttgcatcaattataattgatgcaaatataaaaaataagcgattcaaaatactttttttttgtagtgtgtcaattatcatgttcagtgcaatcattcactctctctgccaaaaacaacaactagatgaagcattgaaactttcaagtaaaatggaaagaaaggggataagagcaaacacgtaattctgtaatagtcggtctttgtcgtaatggcagatgggattgcgctcataaattgttgaaagaaatgatttaagaaattttccgtagtttgtctactaaatcaacaaagatgttggcattgggagggattagttaggaagtatataatttgcacattgttttattttttttgacgtagcatattatcattgctgacataacttttatttttttttgacagattgtttatcatttgatatcttataaagttaataatccaaaaaaaaattgtttagttagtaagttcggcaaattactaatacacggaatatacatataattggctataatgaacattaaagtattcacctaaaatatataatcttttttgtttttgaacaaaataatcttaactctttagccttaattcttgtggccacgcgcatgtgacactcacgagacagcatgaagccttaattcttgtggccgacgttgtctccttgtctctctaaagttttcactttataatttcaacatttctttctgtactctatctcgttatcaaacattcaacatcagcatcgtcactatcgtctattactttgcatgaaaggtttttagcgagcatctacaatttagaggaattcattaattcactaaacattcatttttttaattaattgagactaaaatgtgataaattaaacttgcatgttaatgtattctaatagatctcgagatatgcatcacattctttctgtttcaactgaacgatcaatgtggtaatttctatcttctgtttaataccaaagtttgatttattttttctttcataatttagttttttctttcataatttagtttgataaaaagagggatttaatgagttttaatcaccacatgttatgtgcaagtactatcgtagtagtactaagaaatagttcccacggaaatcccacgtgttactcacagctaatttccttagtatcgaaatgaggcacgtgttatatccacaaaacaaatatcgaaataagattctaattaaaatggatattttggtcccaaaatctcaacatggtagagctggacccaactacccgaatttaatactattaacttgtaaaagttaaactaagccaaatagttatgtttgaccaaaagattccaagaatgttcttcgtctcggtatttattttaaaaccattggctggcactgatgaaatatgggaggaaaatggataattttgatatcgtatttcaccaccattcataaaatatcaaaacgaacataacgattgtatataaatgaacagaaaacccaataaatttaagtgaggtgattatttttatggtataaatattatctatatgattcttgcccaatgtaatatattttcatttttcgtttcatatttctacatttcattttttcttttctttttttacatttcatatccttccatcgtgcaaaaaaacaacgatgatcaaataattttgtcgtaaacgttttgatagtcaaatttatataattaatctgattttgtaagaaaaccttttcctagttttgaatttcatctttttgttgcaagatacagttttagtatttttttaaatgaaattgcaacaaaaagatgaaaaagctaatatctgactaaaactgtaagaagattgttcatcttgtgtcatgttgaattcaggaaacttcttcgtttattttagttctaatagccataagccatgcactcttacttgtgagattataatcatatattcatattagaccaatcccgtaatttggtaaacagaccacaaagggaaacactgttataaactataaattatactacatgtcagtcgtaaaacgtatggaaaaaactaatatatatatgtatatatatgtcagtcgtatgcacttaggttgcgaatttgtagactgatgacgaaaactacagttaaataaaatgtgccaaattaactcctacaatgtttaaaagaagaaacacttttttaagagggttctttaattaattagtgggttcaagctcacacaattaataaattctagacagaactttaggttataacggctaacagctaataaatgcattcgtggataagattacatgtgtcctacgcgcgtatacttcgtatactgtgggtcccataaccatagcctatatatacccctctttctcacttctctgtttctcaactcccagcaaaaacaaaaaacagagcctaagtcagaagaaagactcttaattcgaacaaatctttaatctttttttgtaactaaatacttacaagaaaaaataaacacgttttcaacagtaatttaagttaaccggagtctctttttgttttccggcgaatttttggtactttgagtt

SEQ ID NO: 80 - DNA, 3000 bp, Arabidopsis thaliana
ttatggttttttgttgattttgatgttcattttgattgtttgacaaaaaaaaaagatgttcattttgataaattcatccatttaatataattattattttttatgattagattcatctataactcaaaatatcaattcaactacaatatgaatatttatatatttattattctaatatttcactatcatgatcacatactataacagtaaatgatatactgatataagtagttatattacttatgtattttaaaacttgtctaacttaattgtaacaaacaattctttattccatatattatctcgttatctagtacacaatcacatcctgatatgctagtaatttaagtcaacattttaattcttatccctaccatataatcatataaagtcacatgttgttgtttttttggtatgtctaatgtctaggatgactattacgtgaaaaaattatatatcaatgttacaaaattatcttaacacacaaaatgtaccgaaagaagttcatatgataaatcaaattcacaaaatataataataataaaatatttaactaaaattactaaattaatatgaggttaggtagcaaacatctaaactacaacacaagtaaatttttagccattatagattaatgattattgattaaatgtttttaataaaataagtagaataaaatgaaagtagtgcttggtacattattatgactttttatttatcgaatgttttttagaaaattcatttaagagtgagattaacacaacaaaagacttttaattttttctcaattagttttgctagtttttttatttaattaatatagaatgacacatgtcatttttttgtgtgatgatgtatcatttatatggagagtgtaggccaattttcatatatatatgattttgaataaaaagaaaaattcaaaaggagaaaaataggcagcaaaaagctgtcagttattacatacagctaagacttgagtaatgattttgtagttgactatttcatttcccctgtggacacgctcggcttacggttatgaaatcatgcgttggagtttttcttgcttttcccttttctcatgcgtagagttttttttctttctttacaatttgtttaaccatagttttataggtttgtagctatatgagtggttaatttatggtctagctaattggtctttttcttattcagtttttgcattaaatgtagatatcaatactgaaagttgacttttatcaaaaatacataacaaagtataagaaaaataacgcttagacaagttattacacatatgcaatgttcaccaaagcaagcaagtacgaaatatacatgcatatgataatacatgtaaacgagataaatcagcatcgtaaagatgaactggtaacacggacacgagccatccacatgggtggtacctccttatgcgcgtcttccctcaaaatattgatcattataaaatgatgacaccatagtctaaccttgcaaattgacgccgtattgattgtagtgacatttgtacacgattacacgaagcaataaattaagtgatgcaactctataagatatcgtaagatgatgaaatgtttaataaactaattaaatggatgatataatacggaattgacatttgaggagttctcagccattcattctaaccctctagacccttcttttttaatcttgtatgatttattatctaaataaaagtctaaaccactcattaacatgatatcatcattacattgcgagccaaaattattgcttaacaatcatgaagtctacgtgtgtcacattcggaacctccgaataattatttttatactttttcggtttgatatacttcaatatatactattaatttggataatctcattcttaatattctctcagttccattttattgaaaattttcagaagttttgttttcgcatatatacaaaagaattctaaatctactagctggactagtggaccaattgttggacgcctctaccaaataaatcgtaaaaatatgttgatttcaattttatcaatttggctggaatcgaagtgctcgtgtacattagtttcaaccgcttagaaagacgtctagctaaatgagtagacaaccatttttttaactaatcttttaaaatttatggagttgtgtacgtccactcacttctatttgaatagaaaaaagattaatatggttatggaagaaacgtcccataaagccggtgtgaatgtaatataatgaaatgattctccatcaaactatgattgtaaaattaaaacgcttcgattatagaataaacttgtagaaacattttaacttgtaaaaattaaccattctaaaacaaaacttgttaaaactcaacttacaaacaatgtttgattgaaattgaatatatattatttggagtacgtaaacatggatgatcttatctgaaatagtacataaaataacaaaagaaaaaattaattaaacatataaatttgagaaatatgaggaggatggaaaaaagaagtcacgccacgcctcctatataaacaagagccaagctaatgagataagtgtatcggtgaggctgagagttattcacttacaaaaaaaaaaaaaaacttgagtgtaaccaaaaaaaaaagttgatatactttctggttttctccttaacttttattctttacaaatccatcccccttagatctgtttatttcccgctactttgattcatttctgttagtaatctgtctttcgtatagaagaaaactgatttcttggtttgtattttcttaaagagatcaatctttttttatttttgatcttcttgtgtttttttttctttgtagaattaatcgtttgtgagggtatttttttaattccctcctctcagaaatctacacagaggttttttattttataaacctctttttcgattttcttgaaaacaaaaaatcctgttctttactttttttacaagaacaagggaaaaaaatttctttttattagaa

SEQ ID NO: 81 - DNA, 3000 bp, Arabidopsis thaliana
caactacggatcacaaggcaatgaaatactttcccccactttaacgctccaatgtgtgagcatgcctttaaaccattaatcatagctacagaacctattcttacattgcaatttctcatcccaacaacacaattcaaagcccctatgtaatttcctgcctccaaacaacctccagctattgtgttccaagttacaatactcgcttcgacaccagagagatacattctatcaagaagcttaaaagcttcccctaacttttcttctgaagtataacagttgattattgcattccatgagacagcatccctttcagacatcctgtcaaacaatctccgagcaacatccactttaccaaatcttttatacatagatatcaacgcgttgcagacatacaagttacacctgtgagagctaacctcaatagagccatgaacaactctcccatatgcaaaatccagtaatgctgcacaagccttgataacagacgggtaagtaaattcatccgctctaattcctttactcatcattcgcttgtaaacagaaacagactcctgaaaccttttgttcctaatatacgaaccgatgagcacattccacggcaagggatgcaaaatctcagagttctcagtaatggtctgagcttcgtcaaggagattaaaagcagagtagaaagtgaccaactttgggaccaaaacagagtcaaactccaaacccgacgagatacaatgagcatgaagttgctggccaggaacaaactcattaaaacccacacatgtagatagaagagaagctgatgaatacaaaacgaattcatgagaaccagactggtagcgaagtagagagaaagttctgaaagcttcatataattgaccatgggaaatgcaatgtctaaatgaattgaaaagcacttgtggaactgattcatcatcatgggttttggaagtttctgagatgggtctcggcagctgtttccacgattgaggaataaacttgcaaatttcggatacagtgagacctctgagtatagagcgagaaggagaagacggcatatacagtaagctgcatatgatggcaacgaatggattttgattattgttccaagactagtttgatccatcaaagcgaaagttcaagcaattttgcttctccgtctgaaagtcaaaggaagaaaggtgagaaagataaaaaaaaagtttcgttgaggaatttcatcgaacatgtggtgagcgaaacataccgtatacagacgaaacatggaagtataagtacatctagagaaacataaaagagataagacagatgtcatgtaggaagaaaaaggaaagaagacagtgattcggagacagtatcgacggaaccggacgaagcgaaagtaggagtagccgcgcgtgaaggttatgtagaaagagactcctttttgacatttattcaatgttctggcatgtgctcagatgatttgggccgcttgtttagatttgtccacttccagacccattgcaattgtaacccattttagcccactaaaatctgactgtaacaactttataaatttatggttttttcaaaatattaccaaggttaaataaatcgtgttagatgaagttggcaccagtttttgatattacaaaatgaggtcactagtattttttttataagaacttataataagtaatttattaattgcattatttcattaatattgattttatatatactgatacactagggtttttataaacatttaaattgtctaaaatcgcatagaccaaccgagtaggtgtgaatatttattgtcagatatcaataatctgctagacgtttctaaaaacatctctaatcgtaacttaccaagttacctttgaggtttcttctaaatgagtcggtgactatgataagacggtgtatcacatcacaatcaactcccaaatgtcagtgtcgagaaaaacctaatcaagtatcaactacaaagaattggttatgcatccgaaggatgaaaacacattaaatacattatgagactgggtttctccgtggatgattcgtgttttggatgtggttgtgtgtgaactaaaatttgacaaccatgtacatgagtcagcagacacagaagaagacaaaaaataactttttccagttagtttgggctgttgtgtctgtgtgttgtccgtggagaatcattaagtcattacagatctttggtcaaatgccaaaaataaaggaccccctttagacggtgctcatgtcacgcatgacgcaatttgtaaccaaaaaaggcaaagaaagtctttctttatcccacgtggtttaaccatcgacgacgacgttttcacattcttcatcggtggagtttgaatcgacttttgtgtttttcactgcttttctctatactattatgtcatcacctattttacagatttttatgaaacgaaatagaggatatatagtagtataaaattctagatttcgacttaagactttttcatataaaaaaaaatgaaaaacctataaattaaggtaacctaactatgatataccaaagcaacaacaacaaaaaataaagattaattttctattttaaaaaaacaaaaaatatcatttattttgaaaccaaacagaacggtatatataccacttgttttatagaaatgactcttactttctaaatacattgaatttactgttagacacagcaaaaaaaaaagttacaacttgaaagaaaaaaaaatcgactagtcaggcacatgtcaaattggtaccactaaaaaaatgggtcatactttgaccagttgattttttcctcgagaattaactagttttataattggtcaacttcattctcattcttgattcatattaaaaaatattatataatattttgactttcactaaacttcaacgtataaatagtctttgtatcttcatattcaaacataaacaacactcaaaagtctcttcttcttcttcttcttcttcacatcgatcatcatacaacaacaaaaa

SEQ ID NO: 82 - DNA, 3000 bp, Arabidopsis thaliana
gattttttctgaagtcaacacataattgatgattttaatcacaaggtataaagtttatgttttaaagcaccgcaaattgcgaagtcgtgatttaaatgacatttttcccattataaaaaggaccaaaatgattttgattacgaatgagcaggaatcttgatttatcagtcatccaaaattaaaatggttatccggtttactcggattctttattttgaagaattgaaactttaaaatgtttccaaaattataaatattttaacattatgataaagttaaaatctttataattttaaaaactttttctaaagtttatctttaaaaaagatttaaatttttttataattttaaaacttatgaagttttaaaaattatagattgaattttacaagaaatttaaacattataaatatatatatataatatattaatacgggacgatatattacaggagaaatcttaaatataacaatcaaaattcaatgatgaattttgggtcgatattatatttttttgaagtttttcaaattttataatattaaaatttataagaaaatgataaaattatgtttaattttacggaactaggttatatggttggacggatttgggtggataataatatggaatggtatattacgattgtacaatgtccgacgttgcttaaaaaattggacaatggttcaaagccatagtataaaaaggaccaaaatgatttcgattacgaatgagcatgaaatttgatttatgaggtgtccaaaattataatggtttgttaactagggttctttattttaaagaatgaaactttaaaaagtttcaaaaaattataaattgaattttacaagaaatttaaatattataaacaatataaaagatattaatacgggacgatatactacgagagaaatcctagatacatacagcgagagaaatcttagatataacaatcaaaatttaatgatgaagtttgggtcaatattaatcttttttgaagtttctaattttataattgaaatttataataaaatgacaaatttgtatttaatttcacgggatggggttatatggtgggacgggtttgtgtggataataacacatttgattcttttataagaaaattaaatattataaatgtttatattttaaattttatactacaagtgaaattctagaattgactggtttgggttgataataatttgcgatagaactaggagtgaaatcctagaatgacaatcaaaatataattatataattaaatattaccacgggtaaaattctagaattgacggggttgagtcgatattaatatgggatggtgtactacggatgaaatctgaaaaacaacaatcaaaatacaattatacaatattaaatatttaaaaaaataaacaaatacaacttaaaactttaaaatttgagttataaaattttgtctcgcggtgtatcatacatttaaatcaaacaatagcataaatttaaagatcatcctaaaaaaaattcaattattttttatttaatgaaaatataggcctgcggtataccgcggattaatatctagttgtataaaaacaaactgaactatgtttccctaataaataaataaataaaaaaaaactgaaaaaaacaattcctgaacaattttacatccaattcatagtataacgacatatccaataacacaatttgaattctaatagtaatctctaatacacacttttttatttatcggaatatttttaaactaaattttaatagctacacgagataattgatctattgaagtattaactactaacatagattttaaggtctagttatttcacataaaaactaagttgtccaactactaacgcaattgacaaccacaaccaacaccaatattaagtatgattaccgaccaaatttgaattttataaacatatagaattttttttgccaactcataatcatatttttatatgtattttaatataaggtgaatgattatcttttgtttcatgtcatattgggcataacaaaactagtacaacaaagttgtgtgaaccactccttttatatagttttgttgttgtcttttcttccaaggaagattactagacttagacaagtggattatatatatatatatatatatatatatatatatatatatatatatattaactaatctttcaacacttgtggattgataattattcatacttttaataaaaattccatagttcaatgaatctgtaacaaaaccaagaagtgacgtgatatacttttggaactataatcatattgtgagctcaatggataagaattgattgtagtaaatgatgtcggcagttacaagtgtagttagatatatgcaataactcaaatcggacatgaactcattttaacttatctaaagagaccaccgacgaatcattttgggttcacaaaattgtacttcgatttctaagcctgaatgtgaacgcacgtttttgaatatttcaacacgtgtttcatatttcattacatgcattataacataaatattacatctttgagtctttaactagttgaccaacaaaaaaaaaaactttaactaagtctagctagttttgttactacatatataaaaacaaaaccgaaataaatatttaaaatttataatatatttgtgtggctaaatcaatcaacgtgtcatgaaggtctaattcaagttggtaaggaaatcttttgtttatgtccatttcccacgtgtcactatttgtatgacggctagagaaagacatgttgaattaactagtgactccggattatataagcaagcatctactaaaaagataggaacaacacaatttgattacactgagcaacacaaaactggcgaaccaacgtgactctaacgaagaaaccggcaatggccagtatcactacaatgccgaagaaataacaagaatcataaacgagccagaatattatcccccgggttacaacttgtctaccaccgcaatttcaaac

SEQ ID NO: 83 - DNA, 3000 bp, Arabidopsis thaliana
aaatatctacttttatatattcccaaaaaccattcggcttctgcttccacttcatctctctctctctctcccttctcacatttctctccactcagatttccaattcctaaagatagagagaatgactaaaatctctgttggattgcaacttgtgacaagagattcgagggaaaaactaaacaatatagtgatcaaatcttcactgagactaaaccgatccaatccaaacatctcggagctttgtttccttaaaacatgtcatctctgcaataaacaactccatcaagacaaagatgtttacatgtacaggtacgatatttttttttttttattactatattatatactctttgtaaacgaaagatgttctgttcttgattctcaattttttttttttgttgaaaacagaggagatttgggattttgtagtagagagtgcagagaaagtcagatgttgattgatgatagaaaagaactagaggcttcgacgaagatgatgttggcttcgtacagacgatgtaataacggcgccggaaaaagcgagtctcggaatttgtttgatgatctccggcgacgacgtcaattatttatagttccttgaggcttctttaagcaatatctaattatagtttttttggttacacatcttatgaaagttattagtaaaagaaagagaattaaattgtatctccggttgtcatttttcaaaatcttaaatgttaattggacagtttatgtggtgatctcattctcaggtggtttaattactgatttagtaaaaatgctcattaattagttaggttaattgtagctgttgaccaaaaataaagattacttgtagtcacacgttaattagtgagataattaaatgatacaaagtgtcatatgagatatgactcatatttcataactaaatctgattaattcgaagaacattttaatattcagattggatcgtgacatgatggatatgaactggataaagaattattttaaagaagaaaatctctctgataaataaattattcgatttgcttcttttttttttatgtatgggagatattttaaatgtatgtgacagggacatagacactctttggttgagaagatatgaacaactcatttagtcacgtgttgaatatgtacaggccaaaatactgtattttaaacaattggaattattgttttacttgtcaagtgatcactttgttcaacccaattccccaactaatttattgttttatagtgtcacactgtcacgagtaactaagcaggttcgtggtctcggcccaattaaaaggccaatcaattaaactaaatgcaagtgcctataactcgacctatgaagcccactatcttagcgattcggcccaaaaagacaacttgccttgtgtaaaatgatttcactttgtatccatccaatgattccaattaatgagaagttatgttcagatttaagaattccagttagtgaacaaaaaatcaactactggaatttgttttgcttcttataaatttggttagaaaaacaaaacataaggtttatatctataaacacaaagaaattgtactaatgtacagttccgaaacgagtatagtcaattattaaaagttaaaatagtgaaacaaataattgctccatgaatgacatattgacatcattatctgtttctttgagataagctaatttaggaacttgtctcaatcctgtaaaatgatttggaccctacctattttattcatctgtctttctttgcgttcacaatttgatcttaatatataaatatatagtacatgattgcactaatatatatatatatatatatatatatatatattatatgtagtataactatacacgtatgaagttgaattttataaaataaaattttcttttaactgaatttccaatagttgtttatacataatttagaaagttgcaaccataaaatatatttcaccataaaacaacaaaatatggtttccacgtacacatacacataacacatacctactgaatattccgtaatttacgatgcctgataatttggacctaataaagttagttaagagtaaacagaattacaaggaaattttaaattgagtttaagaaaactagtaattgatttggaatgctagttatcaaacaaaaggacaaatatatttttcggattatttttaataacttttttgtttgtcacgaaacgacaaaagctttgtcataaaaaccaaatcctatcaacttgctcaaaaagcttcaataatatcgtacgtgtcctgcacacgcagattcataaatgtgtttctatgcttttacaattttagccttatgcataacagcataaggtcttaatggtcctctctcctaatcaaaattacattcaaaagttgttgtatagtttttcattatattttcaataattcatttattttgtgcctatgttaaaacattttcataattcatttataatattatttaaatttaaatgttaaatatctgttctgcgttggctactcctgaatgcaaacaacattgcaaaagtatttagttgtgtttttaatgcctaatcacattaatagatactagatctaagggaaatagactttatgaaaaaatcaattgacgttaggtaaaaatttgtttagactatttttgtctaccagcagacaactctgactaaatttttaatcttatttactgcaactaactattaataaactaataaaatcctaatttacaatatagatctacagtaaatgaatataaaagtctggtagtaccgtaaatagtacatcaagataagggtataatagtaaacaaccatcgtactcgcttcatcttttattttactctaaaatctctttctgaagaaaacaacaaagcaaagcgttgaagagagaagaagaagcaaagatataacccccaaaagtatcaattagtttccattttcgccgctaagattctgttttcgaacatttacaccctcaagaatcgccgcc

SEQ ID NO: 84 - DNA, 3000 bp, Arabidopsis thaliana
aaaagtgtgttttgtttgtgtttgtgtttggtggggatttttttttgtaatagctgtaagaaagtaatacaattttaatttatttttgtttaaactttttattgatttcagacctttttttgtgtagtcaattaaaatggatacagacatatgtatgtgacaggcgattttcttctcttcacatctaaagccaatagattttcatagaaaacatgagaacaatgtaacattttcatgttcgaattagtttgcagatacaatcaagattcagccaaaatgaaatacaatggtacaaataccatcatggttatattgcatgtaattcaaacacatggcattagataagaaaatgaattgaaggcaagatacaaaatacatgggtctggtctggataaatctgaatccaaatatttaggtttaggcccaatagcccaatatttatttgggcatatatatctttcgcgagggttcgttggccctattgtcccggccggtgtaatgttacattagccgttaatacacacacatatgaatatcttcccattaattattgactaggtgtttctgcagtttaaaccatccattttagtttaactcaataaccaagagagccactgactcttacctctatacagtgacctcacctcacaaatcatcctctgctgaactttgtttttttttcattcaaccagtagagttaattaaccatgtttggatatagtgttattcttttcttaaggatatatagggtaattactttgtatattttatacaagaaataaacattacaatataaagagctacaacggttaaagattaaagaattaaaatttgtgaagcagacgcgcaaatgactagtgtttaactcaacttaacagtattaactattaagcatttactccaacaaaatatgattgggctcttgtcccgaccccgccatatatgctttctataactcatctcattttgtcatatatacatgattatcttattattattagatgaattgcaggatatcgatcgatttctctaaaattgttgtcacttaatttcagtggaaataagaaacttacagaaagtaataacacttaacattaaaataaacagaagatagttttgacatttttgaaaacgttttgacaaatattaaaggctaaaacagtaaaacatatatatatgtgattcaagtttttattacaacacattcattactgaacaaaaatattaagaaattcaacgaaacttaaatgaaatatatgagacgttcatgcacatcacatctttttcataggtattttcgtatacactagagtatatatatagggttgcaaatatggtagatcaattctaacgttttacgacttcatgtagcttttaattttttcagatgttatattaaatagatttcgtaacccaatcatctgttggtgacggtaagttcacaatatatactactagttaaaatgccaactaatttccttttagtttctgaattcatttttcttaataaagacgattacatgagaattaggaaaagaaatgagtgcctacggaaccatcatacactacagctagttaaagcggatcaaagaagtaagattaccatgagagtgaatctcggagccacaaagaaagagtatataataagaacccttcaaactctcaagtcttaaactgaatattcacagctagtttaataaaagaaatgttacccccacgctaaccccacgtgatattcgcagctagtttaattaagaaggcaacgtggataaaattcacccaatccaaaaaacgcattaaaattcaatttcacgaggaaaatatatataagggctccaccattttttttttaacttttattgtacttgtctcatattgttccatgatatttttaaattcttatgtaaacattatttcttgttgatacaaaatcaaaataaaaataatggatcaaatatttctgtgattattaatgttaattttcaattttccaataaataaagtgatgtataaaacatcaaattcaaactcgtaaagactaatcgtgtaacaataacagaaacttaaaatatttctagtttattgtcaataattttccaagtttgtttgaaaagcattttacattcagttctatgatatattacagagtatataacacagaaaaatgtttgctgaaaatcaataattatttttcacttcaaaaaatagtgtgatttattgatttacaattttaaatcactatcaaacatataaaacattattaacaaacagctaatataaaaaaaaggatgtttaaatattgccagcttcttgtatacagcctatggaggcagcgaaacaatgttcttcacaattcccttcggctttccgtctcaggggtctttcgtttgattgatcgtgaggttcgcaacgtcatctcgtcgagaagacataggaagcgttggcgggagcttatggtgctttggatccgttagctcttcccaaatcttttaaagctctattgtaaccttgtttttatttctttttggcttggttagtcttctttagtactcttttatattacctaatctcatttttatgatatttacaagtttagcaaaaaaatatattgccagcatggcaatgatccacaactaaaagtgaatcagtttagtatgtattacgcgcgttcgattcgttctttgtggttcccaccaaccaacgcctatatatctcttctcacttcactcttctacttcactaccacaaaacagagcaacacacaacacaaagcttcatttcaattctgtttcgagaaccctttgaggtaatttaagcttttcttcttatacattttcaccattgtgaagtgtcttctttgatattttgaattctctgtcttatattgcattttactctgttaattttttaacagagttataaagaataaagaaactttcatctttttgttttttacttttacttgacattttactctgtttcagcagaaccagatcggag

SEQ ID NO: 85 - DNA, 3000 bp, Arabidopsis thaliana
tattggattggggtttttaattcattttgaaatcaagtgttatccattaaaatacccaatccaatatataacagctccttaaaattactgagttaaacattgatatgatagttgatttgctaaaattggttaattactcgttctactattatttttttattttctagaagaacagtcatgtaactagatttcaatctacatatgctagctagactaaactaatatgcacatctcacatttttttctttcttttagaaatacaattacaaaacaaaaaaatcaccgaaagctaacatgtgattggcgttatgataactttttggatttattaggaatggaccggccccgagatatgttctaaaagtaatttattgatttgtacgtgtcattgatcacacacacctatatcatatacgtacacttcatatgcagaattgaggtttaattaaaacgtaccgattttggctaacactgcacgtactaaaaaagacccacttataaacgtatggttgcgtacccatacataactcgtgacctccagattatatcttttagtgaaatagatattttaaaatctagctcgagtctagaagacttttagacatttgatacaagttgagtttactcctgttgaatagctatgatttgattttggcaaaaagtctcatctatatataggtccaacatagagtcgttttctcacaagtaaaagcttgaatgtatctattaattttatcttaacacttctagaccctgcattacaaagtgaactatattattttattagatagagagaagaaatacgagtaattataaaaaagaatatacatatatatgttaaccataaattgaatttttggttttgacttactaagcaatgaaatatatgaactgaagttattaagaagtttaagaaattcctaaaaaaaaaaaaaaaaaacctcaagaaagaaactaaccacggttatattctctttgggaggagattggcataaatcaaaaatatgtagtctatgcgacgttcgtttttattgtctgaattatatcttcattaaagatgaattgtactattgtagtatcattatattggtcaatatatatctctatggggtttatcatttttatgcatttgttatagtataaggcagaaattggaaattgtggttcgtggaggagatgagacgatggagagagaatgagatgaaagtaatcggggcgagaaaatgaaggcgtggcagagaatttatgattcgatacggacctttttaaaacagaagtcttgactcttctctcttcttctcttaccgcaataaatttaaaaagttttttgtggggactacacggactcgtcgttatgttaaattaaatcacccaagagaaaaaaataaacgatggaaggattggaatttttttggatttgactcggttggaaaacttgccattaatatgtgaaggcgtattgcgagaagacagagaagatgtatagtttctgctatcaaatgcgtgttttattaatggtcaaaatggtgtcgacaaaactatcttccgatgatatctactgagagattaacagtttatcagatgtaagtatgtatggaattgaagaatttatatgaaataacatataatatatttgatattttaaaaataataataatatgacttattggaaagaaaatatgattttagtatgttttcattttgcatctatcatagatggcatcattgatactagatgtgttctaagttctaactaatcatattgcattttgtattaatggtaattaattaattgtggtagtcgaatgctcaagctttccttttcatttgtacccaaaatttgatgtattacaaatttcactagctcttactggataattggaagaaaaacaagtgtgaatgtattccacaaaagaggtgtgaatctaaaacgtccaccttcggtatgaaatacatattgagatgaattttgcgaaggccataaacaaagctacccaccttgttcattagtagaaatgtatctatttattaatgttactacacatctcgaaagttaaggaatattacttattatgtttcagcttttgaattagtatattgtaccatagagagttgtaacaaacaaaattttgattctcgctagtacagtagtacagcattagtctacaccaaggtaaactttaagaaatagatttctaacatttgtttatattttcgttattaaacctgaataaaaaattgcacacatctaattgatcaaaatattttaattttccagagtttagtttgaataaattgaagggtatgcaagttcttaaatcaaactttcgtataatttaataatgtaaactaaatcatttatattcggtaataattagatataaatatctatcatagtctgttaactaatgaaaaaaacattctaaaataaagcaaataaaatcatagactctattaattttcatgattagtagaagaatttatgcaaaatgcaagagaaaagtatattgatacaatctcatagatatagatatgtatcatgagtatagtgcttataattagcatgaaatgattaataacactagaattgtggttggaaataaggtatctacttgtattatctcagagtagaaaccttgtagcaaaatcatgatgaaaatcgtttggcaaactttaaataaaagaagaagaaatcaacaagaaaaagtcaaagcgtccatgtgaaatctataaaacaacctttctggtttgttttccttgtctatctgtctaagtctataaatatgtacaagctctttctaaactttaaaaacccattaaatagatctttaaacaaaaaaaccaaattctacttttctttcaaaaacaatctctcattatctcaatcttactcttgttcaatctcttttgaacttgaaaaaccatcattctatcaaatcaaacacaattgttagggtttctttttatcttatactccacgaaacgtctggttgagaaaaa

SEQ ID NO: 86 - DNA, 3000 bp, Arabidopsis thaliana
cgaacacgtggtgtgctgattgctgaaccatactatatacacatttgaaccctaagagctgagagtatatacatagcagaacctatatgattgagaataacgaaacagaggtaagagagagatattggaacaacaaagcaaagcggaagaatgcgcgcgaaaaaacgcaacaagagtacgagactctgaagatgaagagtgaagacaactccatgccaaatttgcttgtcggttactgaatttatgagcctttctcctaaggcccacattggcccaactgtttacaaggcccattggggctagtttccaaacaaaatatctgaagaagtgaggcgtgttggctaaatagaggcccatataaaaaaagtgtggctaccattattcttcttcttcttcgttatccacttctctctcctttgtgtggtcaaatgcatttccctccattctcttacgctttctctcactctcgtcaatggcgaccaccgcatcttcatctctcccccgtaattactccttcacaactccgcgaccttcatcattcatccgaggaccgccattagctagaacgctgcctctctatctccgccgtaaccgtcgagtagctctcacttaccgattggaccagaattcgaagcagagaagtggtggaaacgtaagatgcgaggcgacggaggtatcttcttcttcttctgtatccacacctggaaggaattgggtgccggtggtgccgttatcggcgcttccgaaaggtgaacggcgagtggttattcaagacgatgagacgatattgttgctttggtataagaacgatgtttttgcaattgagaatcgttcaccagctgaaggagcttatagcgaaggacttctcaacgctaggctcactcaggttttcttcgtctttgtactttttataatttgagcttttttcgtcgtttggaaaaatttcgagcatgaaaggtatttgtgaaaatgcctgaccgagtagtgtgatagctttaggaaaccaagcttataacataagacatctttagctccttaatcaacacatagcttgagttgcttcatcacattggttatggttttaaactgttgctataatgtattagggtcttggttttaatagtagtttttgctcgaagtactcttggtttctctcatggtgagtgatctctttttggcaattatatcaggatggttgcattgtgtgtccatcgacggatagtacgtttgatcttagaactggagagatccgggaatggtacccgaaaaacccggttctcagagtcttgacacctgcactgaggaaactatttgtataccctgtcaaatatgatgaggaaaacatctatatcagcattagagacagcgggaaaacagaggcagctgctgagatcgtcttcagtggaaaagctcagcctgggctcacagcaacaaacgtcaatgtagacgaggtaaaacacctatacatgtgaatttgtttcatctgggaagataaaaacaaaagagtgatgataaattttgtgaatcacaggtgagaatgattgtggacgagggttctgaaggatttggtttcacgaagaagaacgaagtgataaacgggaaggcggcagtgataggattcttgctgctgttagatttcgagctattgacaggtaaaggtctattgaaaggaacagggttcttggacttcctttactctgcttcagatgctttcaagtagaggtaatatctttgttggtctggttttgcttgcctcctttgtgcagtttgccgagaaacaaaaaaaaaaaaaaccatgtaatagtatatagagatggctttgctctgtctttctttgtgtttaccccttatacgagatattctttcttctccttgagttcaaattataatcttcaagctttcccactatcttttgtatttgacatacaacacctcatatttgattgggtgaaacaaaaacgagagaaaatttcaataaccatgctaggccacttggactatatagtcttcatttctattcatttctattcattttatgatttttgttcaattagcaatataggcatacataatcttttttttaataaataaattaactctaagaatttggaaaatattattaagtttatgagataatgtatgttaaatgtaaaaataacatataatataaacctcttaaccataatttttttattaaaagaagaaagggaggtcattgtagagactagagagtacattgcattcaaatttggttgctcaaaagtgagtgattccgtgtgcggaatcttagtttgtgttaaatttgagtaccaccaatcaaagaagagaccacaaatctcatatcccttttcgttttcagtgtgcaaattgcaaaacgagacaagacaaaaaataacttttctgccctttagtcaaacttataagcccaagaagagcacccgtttaagactatttgaagacgtcatgcctgatgaaattaaccaaacaaaataagagagagaggcaagtctcatgttttcttttcaagtttcagcacgtgatgtcgtgatggactgttgtgtacttgtgtgttttttaattttcttttctatcagactttttgaatcaagtcgtattgatgatatggatcatcaggtgatatgatgactctcattacgttggaaaattcatttgtttatccaaatgggtatttagttgatgtaaacctcaacaagttgaaacttgaaacacgactcgaatattccaaagaacccaaaagctaaaactaaaatagaaaacgtcaaccagtgcgagccacatgtccatatctcataacccccccggtcatactttgaccatatattatttgtttattcatctcataacccaattttaaaagtacaatttatatacattcaatttattcggacttgatctacacgactttattccgcttcaacgtatttatatgcaacattttccctcatgatcttataatctcatcttcatccacccaaaaac

SEQ ID NO: 87 - DNA, 3000 bp, Arabidopsis thaliana
taatcatagcctttagagttaattttgttgggacttatgtttactgtattctcaaagaccaataccttgtccacgccaggatgtgatgccaaaggagcaccagcttccgaaccgaaaccagtcaaaacattgaggaccccaggaggaagaccaacttctcgacaaatatcagcaagctccaaacaagtactgaatttagaaccatgagacgtgttcaaataaggaccaatacagaagcataagagcaaaacagattatacacaattacgtacactgatgccagctctgatggcttgagaatcgcagtgcaccctgcagcaagggaaggagccaccttccaaacagccatcaaaagggggtaattccttcaacatcaaaccagatccatgagtcagtttctggtcatataaaatagaataggtgccatatagactcaaacaagttaaccacaaaaggaaagctaccatggtgtaataagtcccacaactccgagaggttgcttcagaacataactcttaaaactctccatgggaagcgagactggtgctttctgcttagcatctaatccttcagcaaggtcagcataaaattcaaaacatccagcaacatcatcctgcaaaagatcaaacaaacacatttaagatcaaacctacaaagaaaaccctacatttcacaaaaacaaaatggaagcaacagtaccatatcccatactgcttcatccaatggtttaccacaatcaagcgcctcgagctttgccagatccgtctttctttcatttacctacacatcagataacagaagactaaaactgattacacaaaagcccaaacaaaactgaggctttgtcaacacagcatcacaatcacaaacataaaatgaataccttagcagcaatagcacgtaaatacttagcacgaacagctccaggtgctttggcccaatctttccctttattccttgataatgctcttcgagcagcgttgacagcaacatccacgtcctccgttgtagctgcaggaatatcacctatctcatccaacacatacaaatccttggatcaacttcaactaaaattcatggaaagaaagtagtcgatacagcaaaagatagtcatgaatagagttaggagcaagtaatatctccacatcgaactaagaagtaaacaaaagtatacatttttacttggatctaatcgagctgtggcggattttgagaaaagcgcttaccaatgacctcttcagtagctggattaacgatcgggattcgcttcttcaagatgggttctctccattcgccgtcgatgaatagctggcgagtaggcatcggaatcgccattgttcttatctgaatctagagctccggagatggagttgctgctgctcactggatcgtggattcgtggtgcaccgtgcacgcacttcaagatttggactttataagtagctttcactaatgaagaagagtaggaggatcaaaacgaaaaagcctctcttttttccttgttctgctgacaccaaccagatcaactttttttaattataactcttttactaatctaattaaaaatgtgtatttagttccaaaataattaaaacagagatcaaattttcatattatgaacaaaaatatatagaaattagaagaactaaaaatcatacacaaagttaattagaaaaggattagagatctttaaacgtcacttttttgttttgtttttttgcaagataagaggtgaatcaaaattgaaaaaggaaataaacatgtaatatattccaaacgttgagtaaaatcctaaaccggcaaggattaggttccgtaaaccttataaatagagagttcgtatagtctttgttttcctcatcaatactcaaataactcatcgacttatattcctcaatcttccttcttcgattttcttaatttgtgatcttttgatcgataatggcgaccacaacaacaagaatcttctccttcatgctcatgatgatgagcttcaccgttctaatgggatgttgttgctcagcgaaaacctataaagttggtaactcggagggttgggggcaatctgttccgtgggttctgaacaaataaataatagtaacaaacgattttcccaaaatggaaattgattattgaatctaagggagactgttcttacacaaggttgtgtcacaagttcattagtagtggctatctcgagcaaagtataatgaaagttagtagtggccactggccttcaattcaattattgctccatcttgagaagtgggattaaaagaaggtaactttttttaacttatttggaaaacagaatgcgtaaacaaaagagatagctactgctctaaatagtgttcatgtatgaaacttctgttttggttccacctttcttcttctacgaatctcaagttatgatcaacagacgactcgcttctttcttcaaaacagtgagtcatatacttgcttcttaacttcttaattagtgtccgcatcaaaaatgtcatgagcctaaccattgatgcaaacatttataataacaatacttatgtgtgtccgattcaacgcccaataatctctaaaatacaaaagaagaagtagtcttaaaattctagaaacagaagtcgcgacgaaaatctcagtatttaaaacaaacgtgcctaaacaaatagagataatcattcagatataatgcaaaaagacaaaagagagttgaattaaatcacgtggaaaacaaggaacacgacaaagcagaacagtctcactattcccgcgttagccactcaatacaatccgccacgtgtcccatcttcacgcgccagtcagcgttgatcttcttcctcacttgccacttccacttcttcatatataaatcccacacagccgcaaattcgaaatcaaccagatataacagaattaacctacacaactgaaactcgagttaagaaccggaaacagaatccaattcaaccaaaccgaatcgaaccgaaccggagtttttatcca

SEQ ID NO: 88 - DNA, 3000 bp, Arabidopsis thaliana
agtttttattataaaaaatattttaattattcaaaaatttaagtgttgaatttaaatgcattgaaaacaaaacggactaagcatcccgtcccattatacgggtccgtaagaggtgttattagttcaaccgttttttacgcaagtaaatttatctcttagattatttttaatggtttttacaaatagttttattatgtaaacttatttttcaactaaagttttttttatataaattattttggttttcaaaaaatctaagtgttgaatttcaatgcattgaaaacaaatcggactaagcatcccgtcccatccaacgggtccttaagaggtgttattagttcaaccgctttttatgcaagtaaatttaacctttagattaatttttattgtttttattacaaatatttttattatgtaaacttattttttttaattctattttttattatgaaaatgttttgtctacaaaaaaaaacttttaatcactaaagtttttattctataaatattttggtttaatgttgaatttcaatacattgaaaacaaacctgactaagcatcatctcgtccgtttctatgggtcgtaagaggtcttattagttcaaccgcttttcacgtaatcaaatttttaacccttagattaattttatgatttttgttagaatatttttattatgtaacttattttttaattatattttatattatgtaaaagtttttattacataaaatattttggttttcaaaatttctaaatgttgaattttaatgaattgaaaacaaactgaactaagtatcacgtctcatcctgaaagtccgttataaaattaactcttacattaacttttatggtttttgttacaaaaatttttattatgtaaactttttttctttactttatatttttgattatgaaaatggtatttgaaaagttcaaataaaaaccattttcaaataatctaagtgattgttaaatttcaatgcaataaaaacttcgttaatattactcatttacaaagcttcggttttgccgttttggtaaccaatctcaaaagtcagaagttatttgctagaaagacgaatcaaacacagttgtatcttttgaaatgatctaattccaaaaagataaattcaacaagggaaatcatgcaggctccctaaatgtaaatcagagttacaaaacaaacacacacgacgacgagtaacgagtaaacttcttagaaacgggatcttggttgtgtaaaaatgtaaacctcgtcgaaacccctcctgcaagattgtatgatccaaagacatcgttaaaggacatcattgtcaacaacgaaaaacaagagaattgtgcaaagactgtccttagtggctttaccctgcgtagtaagtaggcttatagttgtatatgagattgctcagcactttcttagatggtgtctgttcagtgacgtcctagcttcactgcaccacattcaaccgcaatccattgagaaaacaaaaaatgttgttgggaaaactgtgaaaacgttgatgagggtgatcttacattcttacctgactaaataactagcagcatgctgtgtcacctggattgcatcctcagagtgtggaatcgcagatgatccccattcaaatgcatttttctacagagaattaatttagtgcattaagagctttgtttttttagctgtcaacacagaatatagtactagaaatataagtttaattgcatatcttcaacattttttatattgtggatatgttaaagttatataagcagacatcggagtcaaatccatcataacaaattcccaatcgaacaagataattcatactaagtatctcactattttctcgatctacataaatcatcttcatttctcttgctaaatttattttttcaaaaaaaaaaaaatccaaaacaaattaatggattttagttgcaattacattgatttggtaaattatgttttgcaatttccataataatctacttgacattgaacgacttcaaatttttaaaaagttctatctgagaatactagagataatatttagaacaaaaaataagttagataaattggaaccggagctttgtagttatcggttaaaaaggccgccttttcacgtgtgtctcggccacaaatgttctaagacagagaagtaagattcagtgaactttgtttgtctcttatcgaggaaccttcgggtcccgtacgtttaatttgcgtggacatattgccgccacatgactgacccttacacacattcatacttgtactttgctataatttcccacgtggcaattaaaaagcctggagaaatggataacatcaagaaagaaaatggtgactctatgaacgaattaaaaaaaaaactacaattctttctcaatgtttatgcattagatgatgattctttttttacaaaaggagagattacatgactcatagagaaaagctttataaatctaaaggctttttaattaaaaaagtttgtatatataagaaaaatcatgtatttttttctttctttttagctatttgaaattataattaagttaaagccatagcttgattttgttttctgatgaataaagccatagcttgatattagatagaagcattcacatgacgagccattaattcatagtgataaatctttttatatttccccaatcgcggatgaccttatccatatctctctctctcttttctttttttttttggaaaaatctcaaactcatcaatctctctgctggttttacgattactgttgccaaaaaaagaagggtctctcgagacaagtgttaggattacaaacacaacaccagcttcctcctctcgacacgaccctccgtcatgtctgcgccagctatatcttctcctcgccacgtttcatcactctcttctagtatatatacacacctaaccattacctcatgtctttgccttatcactcaccaaaagtcgtcacataatatcactttcgagttatcaacatccgtac

SEQ ID NO: 89 - DNA, 3000 bp, Arabidopsis thaliana
ataatggtggagttctcggccaatccctccctaaacctctagagagttctattaatttttgtaactatttatgtcgactaaagtctaaactacccattataattatcatgattaatacttgcgcgactaaacaactctttaatattaaatattatattatcttaaatcatgatgtaaatctacatcactatcggcgtcttaagatatttttcttaatttcaatattatttcttatataacgtcgatagttgaattttgaaccacattagtttggctaattttattgaaacttcttagtgattacatgttaatgatagatattatatatttttaattacatacgataaagtgaaattcgtattttaacagtttcacgttatttatgaaattatgggtgtgtgatctatatagcttgattagtttctcacatgttttttttggaaccaaaattaaattagttcccagataatatctctttttatctccactaagaacgaaataaatagaaaatgatgaggaagtaggtgacccattaataagaatatcacaactgttttggaagcatccctgtaccactcactatcttattcttatctcttatctttcgttattactaacaaaattattattttataaaagcacacactactatatttatactccccaaaagtaataagaaatccgatgaaatacgttgaaaaaaattcagatatgatcaaccggtgtatgaaaaatgtaagatagtaaaagtcatatcatgtgaataataagaagtacaatgttgaaggctatggtaaaatagtacaaaacaagtgaaggatatggtgtgaagataggttttaacgattgggagaaattacttaacttatttcgtagaaaaatgatttgtcaaaagaatgtgttattcttaaagagttttggttaaactttcaaaaaaaagaatgatgggaatgggatcactcatagtttctactaatggtaacaattcttgaacaaaaaagaagaatttattacaattttggatgcttttaagtttttgaacagaaaatataggaaaaataaatgaaactagagcctaaaagtcagcaagtttatgtagtcatgattataaccattaaccaataagagtatgagaccaataaaagagagatgattaaaacacagaacctagctaagcaataacaaacaaacaaataagcaaaatggtctgtgaactgtgaagtgtgaacacgaaccggatcggtcaacaaaatcaggtatgactatttactccacaaagcacaaataatatgaagacacgtgtttttgaattatgtattcctatttgtataatacacgcgtcattcactcattagctgcatgtcatttttctcatccgctcgcaggtaggaaaaatacagtgtacctcgcgccgattatatgaatttatcagcctcatcataattcataaataataaatagacgaaatgaaacaattctggaatagaaatatgctgatctaaacaaaatggatgattataaaaatatataaacaattttaagaaaatttggtggatacttttcttatttttgaaaaatttcatgaaaagagagaatgtaaaaatagacttgttatcttacaattgttttctacattgcgctacataaaaaattaagagtacataatatatttcgtttgaacatttattccttttataaaattatgttaatgtagtcatgtttctaaattaaattaacaaaatgttaatgtagattaaatatcttacttttttttgaaatttcaattagtttccaaaatataaatatttctatatatagtataaaataattcataatcaaatcctaattgaaaagaagtaaagattattttaacaaaaaaggggtttgacattagagggtaaagacgataactttaacgacaagttttaggtggattaaaaaaagaaaagttaggttgtatcattaaatattccatatgcatcattttaagaggtgtttaaaattttaaacacaaatttaaagaaaaacacgatatttttatttaatttactattttatataaaacgccagaaaataaaataaatacaagtattcaactaataaaaacatattataaaatatgattggtcagaaaaaagtaaagtgaaagatcgctaaaacatcacttaaagtaattctgaggaagtattagtatttatggtaatcatttatcattacatattttttttactaacacagtctaatattattttttctaacactactacagttttatttactgtcaaaaagtttttaccatcttgtgtgtcatcaaacaaatctactcgcttaggtattttgaaatataaaattgcctaagaaacggaaaatatcgttggaaaaaacccggaaaatatgaaaatagtgtgaggagactacacccactatataaacaagagccaagcaggtgaggttagttcatcggtgaggttgagagtaattcactacacacacacaaaaaataaattgagtgcctcccccaaaaacaaaattggtagataacgagcaattgttttttttcagatttgatcctgaatttttacatttttttttttgcaatctccccctaatctgttgtttctcgcttcttcttctgttaatcatctgtctttcaaaaagaaagaaaaaagaaaaattcgatttctgggtttgtttttgtcatacagaaaaaaatcaagcttatgaatttgtgtttaattttttgttttaatttgaaaggcaggttttttcagaacgagatcgttttttcaaatttcttctgattttacctctttttttcttcttagattttagtgaatcgagggtgaaatttttgattccctcttttcggatctacacagaggttgcttatttcaaaccttttagatccatttttttttaattttctcggaaaaatccctgtttctttacttttttataagtctcaggttcaattttttcggattcaaatttttattttaa

SEQ ID NO: 90 - DNA, 3000 bp, Arabidopsis thaliana
aacaagtaagggtaaccacttgattctacttatcatatgtgaaacaaactcatctaccacaataaagaagtaatcagggagaccaagcttcagatttatgcgcagcaccaggattaaatccagaaatcctgacaggacagatagggaaagtgcccagaagacgacattcctgaaagggaagttcttcagaaagttctgatagagaagtattcccacaagagagccaattgcaccaaacgacataatggatccaacggcttcctaagcaacagaaaataactaccttagccaaaaacatcacagagagttcccaaatgttttaagcaaggccatggaaggtgaattacagctctagagcttatgcaaaaggtgaaagcacctttgaaaaggaagggccatcctttgaatccgtgtaccaatagaacatgccttcgtgaatgtgcaagctcactgcagctgacaatagcatgaacaagcatggtcgccacacctcaccatattgaaaggttttccatattgcacttccagcatccagaaacttgtcgttaacctgaaagcacagttactcgattacattactagcttaaagaatctggttggaccaaagggtagcaaaacacttacatgcttgcgacctagactgcgagaaggagattctttcagaaccatcccaaccacaacaagcaatcctgccgtcacaccgagtaaaccgtacacaccctgccaccaaaaaaagaagacaaaatgagtggaaaacacttgaagcatttcgactctatgcattcaaagagatctttaaagagcctactttggacccaaccaagtgcaccaaaacgccgctaagggagaaaccaaccaaggaaccaatcgaagaacacaaaccacacaaactttgcatatctgcagcaagtgtaggatggcttatgctacattgtgtcacacaagcatcaatagttacatctgctatagcaactccagcacttcctgccacaagacaggacaaagccagtgcaagatgcagattcgtgtgaagccataacaccatcatggagatcatagcaagaaaacctaaaatcgaatcgaacaaaaaaaaattacatctttcattcattaagaagcaaagaaactaactttcagtgaatttaccggctaatatgaaatagggtcgtctcctgtaacccaaaactgggacaacatcagtcaacaatccccagagaggtttaataatccaaggaatctgaatcaaaccaacgtaaatctgagcttgagagggttgtatcttctgctcgtctttgaagtagtactgtgtgctgactttgctgagacctttaccaagtccttggctaactccatagacgataatcacaccgaagaagaagctccagtgaagctcttcgatgagcattcttagccaccgtaaaggtcgtttcagtaccagatctaaaactccttctttcttcttgtcttgatgatttcgccgagaatcgttctcgtactctgcttcctccgatcgattggccattagagagagaagttgacgaacaagcgatctgactaatgaattggtacccaactatatagaaagcacacgaatcaaaaatcagagaatcttgttaaataaccaatgtttgaagacgtcacggatgacgaaatcacgcacgcacacaaaaatgtcttggaatttcaaactcaagatcaatgggactttggttccaatcttttcaaattacttattctaaagatatagaacattagagtagatgggctttttgtggcccattagttctttagtcgttcggtaggcttatttgggcccattgtttctgtagacgtcttgtgggcttcatttggctcatgtcctgtctgttccaaactaggcaaagcctctgtcttagtaagagggtctttaatgttgatactttgtcataggttcatctttgtcattctagaatcaatgttaatacctaataatttcatgcgaaaataaacaaagtatttatttaaatgcttacttatgatttcagatggccaaatttcacaatcacatagattcctcacctgtcactaccaaatacatttgatttgaagggtgcttattggactctaattggcaaacttttaccataattgttgacaactccttccacctgcataaaaatgagggcaggtagtagacacattatatttaataaattatgacttttattcatacaaacattaataaaacagataatggtttggaagttatgaaatttattgtgtgataaaatttctcctgtttgtgtgtgtgtgtgtgtgctgttatgatcaaaacgtcatatttgtttaccaagtgctaaattattgggagaacaggtaaatatgtacaaaaaaaatgaaaaaatataacaaagtttcttgctagttcggcatcacatctctcatgggccgaccaagaagtagatcaaccaagaatcgataaaacttgaggcactccatttttttctttggctaattaggttcttcgacaaaaatgagcagataaaaacaataatacagatatggatcttttttgctagtcataatcaatttagaaaatggttcattaattctgatttgagaaattcttaaccgtggtgtttaataatcaatctgactaagaaaagtgcaaaaatggtagcatatatgaatctaattaagaaaacgtgacagtggactagacacggttatatcaccggaaataaaatctattaaaaaaaaatacaagataattagtgccataatcttagtgactttatcatatgatcagtacaatttaaaatattcggctgagaatctgtatttaaaccaaaaaattgttctaaaattttaacatatatatatatatatatataaacgaaaaaaaagatgtgacggatttaatataaatatactcaaccatttccaactatctgtctctcattttcataattccattttcaggattgtctctcaatcttttattcttctcattcaccggta

SEQ ID NO: 91 - DNA, 3000 bp, Arabidopsis thaliana
attcctattaataataagaaagaaactaattaaagatgcattgtatacgtacacatggtcatgtcccggagaagcaaaaggaaaacaaaacggttgaatgcatagaataagtgtagaagaggctgatcaagggacagggtaggacttattgttgcacatgcatttataagccattggacaagtctcagcctcttcgacggatgcacacacaaagctaaccatcacaagacggcatggagaacacgagccacacgcgtgtgagcaatctggcaacctagacccagccacctgcaccgtgtccggcctcctcctctgacgcttcaatgccccggtcattcctacatgatgatgacctgcacatgcacgcagacatgaacaagttagagatcttgaagatagtgaaagagctggagtaagaaagatgtgcatagatacatacttggatgggaggatgttggtaaatgcctagccaagagagagccaaagaagaaagagaggaaaaaggcaaggagaagaagagacttcatgatatattatcgcaagtggtaaaagtaaaatttgggatgaaatagtacggcgagaaacaaggtatatatgatcgttaacaaagggttaggaaattgaagagactcacggtagagaagaggagagagtcacatgaaaacaagatcgaacatatgaaatgatataaattttgaggagatgatgtagagtatgtgaagcctaattaagaacttgaacttcattcgtgctgctttggtgagtgtcatgagcttcctctgtgaaaaactgaaagacatacttttgtgtgcaatcacctttaatttaccctctataacccttcttttctgtgaccttcattaatgcacccaattaatgttcttactaaaaaaaaaaagttgagcatttgatgagatagaatgagggacattgtcttggggcttgtgttttaaaatcgataatataatagagttaattacacatgaggttattaatgatttaaatactgattatactgaaattgcacaattgttttgaaaatgatagtatgttctatacttgacatctcaatattttgacactactacactttaagcgattaatgaaaaaatattaaagtttcaatcaactttgcacacaaaaaaaagtttcaatcaacatttgaagagtgtcgaacatgcacctcaccaatcacattacactataacttttctacacctttctttgggatgctaaatttcaatgaaaattttcttattaagtttctatttgctaaagggggcagaaacatcaaaggtcaaatgatttagttaccaaagtcaacggcttaacatcataaaatcatcttctaggaatcaatgtccctttgagtagccttcatagtataatcttcaaaactttggcaagttaatatataaatatgaagcactcataatataactggtataagataatggtttgggatttgacattcgttgcattcttaatcaatctaatcgttttctcaaactgctgccaataaatttaaaagaagagaaaaacttattaagtagaatgatggaccacgttaaaatatcttaataagaatactacataaaatactaatggatagtgtataagtttaattggaatagcaagttttatgattggagagatagagcatagagagataatgaaagtggagagagctgacccattcattcaccgactttttaagctttaagctgttgactttttcttctaacacgaaccttttcccttgtctttgttttctttttgttttgttttgttttggagtttgtttatctttatctgccgaaagtttaagacttcagcctcccaccttggcacctccttgcgtccacgtcatcttaatatgtaccaaggtttctaagttcttcatgtcaatagacattataacatatttggaatccatattatgcaaggagacatcggttttactaatgcgaattgaggggcttgtataaaatcggtctgcttcagaaaacattccatttttcaacccttgaaagtccattcagtttaccatccaagagtttttccttgttgtgaatgataagaaaatccataacatttatctaattttatcgtattggaaaaataatttaatatttctgaatacatttattaaaaatatagttaaaaacgatgtatttttagcgttttataattatttagcattatttagatgttttcgttattttgttattacatcattttaattattattcatgtgacttgaaattaattactttttaaggtcgaatctttttttacgcctgcctttacacttcttattagaaggttatgtatcgaaacagccatccaaaatttaaataaattctaaaagaagttatatatattatgaatgtatggtgatactgacatgggtagggtacattctttttctattgagttagttgatacgttaagttggatgagatataacttatactatcatataagctttttttaatttgtgtgtttcaagtttggtcggttttgtttatgtcttttgtaggtggggtatacagaaaaataagagaaaaaaaaacaaagtcaaagctgactttgacgacaaatcgctaaccttcgagagatgatgataacaagcctaattaaaatacacgttacgtcgcaatcaattgcttcaatctcattctcattgcatgtcatccttagccgcggttagccgaccatactatcaacgatgtgcatactatcaacaatgtatttgtaataattaagtagaaaaataaagaatgttccaccgtccaaaagaaacacaagtacggtcctgagagggcttgagatattttgcttagtgatatatgtcaacatcttagttaagccccaccggttctgatataaaagtggggaaaatatttcataaccacacaacaaatctctctgtttctcccgctcttgctctgttttctcaaagacaaaagaggacatcgtcgttgactcctcttctct

SEQ ID NO: 92 - DNA, 3000 bp, Arabidopsis thaliana
cccacgattgaagataggctttcctccatatgataggcttgtccaaagccacactgcagttacttgactaagaagcgattgtgataaatcatcatcatgagccaagttctcaggctgagctaagagaatattcccagtcctgcttttcatcataaacgaaagacacttgacgtacgagcagtcatctgtgattttgcttgagattaccatgagattagttggtatacgtgtccggtcaactgtccataacataagctcctccaaaaatcatagaatgtatccattaccttaataaatcttgattaaatagtaatataccgttatcggaaaaataaaattcaatataatagtttcattcacttttaaaattttggaaaaaatagatataaatataaaactctttaacatttatctccctaaaacacgagatttaacctaatatagatcataattaaatcaaataataataggaaaaccaaaaaggaaaagagtcacgtttattgtcggtgacccgtagcaacgaaagaaataggaaggtcaacaattttctcatacccgtatataaaacaaatctatctctccttccctctttaatttattaatcagatcttgcccaattcttcaatttcttcaaccctaattcttctctctttctcagatctaccaaacttgatctccaatggcttcctcagcaccaccagtcctcccaatctccaatccccaaaccgttccatccgccgctccttcctccgtcgaatctcaaccaccgatcgctactccagctttccgcaatttcatcaatcagatcaccgaaaccgttaaaaacggtctctctaagcgtcgtccttgggctgagctcgcggatcgttccgcattatccaaacctgagtcgatctccgacgctgctgttcgtatccgcaagaattactcgtatttcaaggttaattacctcaccgtcgctacagcgatcgtcggattctctctcgtcactcatcctttctctctcgtcttcctcctctgtctcctcgcgtcgtggctcttcctctacttgttccgtcccacggatcagccgatcgttctattcggtcgtacattctccgatcgtgagacgttagggtgtttgattttgttcagtatctttgtgatcttcctcaccgatgttggatctgttctggtttcggctatgatgattggtgttgcgttgatctgtgctcatggtgcttttagagctccggaagatcttttccttgatgagcaagagcctgctgctaccggattcctctctttcctcggtggtgccgcctcttcagccgcgcctgctgttatcgccgctcgcgtgtaaatgcgattccgatctaccattccctcgcctgggtaaatctttctatatgattcatttgttgaatttgatacttagattttgtttttttaatctgaaaacaataaacgtgaaaatgttgtggatctggcctaattttggttcttgttcatgggcaatagctatagatgaaatatatatctttgcatgattttgatttgatgaagttttactaccgttttgtgttaatctttagccttttttaatttacaagtgttgttttggaagatatggatttatttcatgatcaaattcaaaatgcaatggatctgtttattagaacttgtagccatcttttgatttgttatgtgactacattgcactgcgtgtatacaatcaaaagagtcaaatttggatgcatgtgcatgcaagatccatccaaatttcaccagttttcaaaagcacccatcataagacagacctggatcagagtcgtaggatttaacgaaaggaaattacttcctattgaggatgagcagcagaacaatatccacattacgcatttacgctacttgacttgacttgaaatcgtgggtcggagcaaatgcgatgcacaaataattcgatgagcagctttagtattgggcttcgtactcgagtccggcccagtataagctcatttacttcttttcgagtccagttcggcaaaggcccaatgtctatgaaatatcgaattggtggcgtataccctaagccaacaaggaagcttcgttttaaaaatgatttgttacttacctaaaattaatagtattgggtgacaatccaccttacattcttatctttttaagggttttagcttacggtataagtcaccaatttgacatcttccatcaacgaaaattagtaaattacaaaaaagtacaaagtcttagtcgcaaatatctctataaccaaaagcaaagcaatatcctaagttgtattgacctcggaaactagaatctccttgaacttgggatttgtcaatgccagtgacttagaaattgttctttgcgaaggcaaaagctacagtttgttagttggcgcgcaatttgagctgggaagagtccaatgagagtaccaaaagtctcggactaaacgtcttcaaaaaagtaaccatggaataataatttatttttatagtatagtttgaaacaaagaaaaaaagaaacacgtttgtcagaaaagtaataagtggaagatgtcaaattgctggcttgcaccgtaagccaaaaaaacactgaaaaagtaaaatttcaatttaaggtggattggtgcccaagacttacaatatctatttcttcacgatatttacgataattttcaaagtcttagccgcaaagaaatctataatgaccaaaacatattgaaaaacaaatcctagcataccagaatctgcctaaactgggaagtcaccacgtgtcttgtagccgtacatttaattgtcgtaagcaccacgcgtgttctcttagacggtatctagacatgtgttcccaccttaatttctgaaggctctggtgaattctaggacaatctatgcagacaaaaatttatagtttattgtttggttttatgttcgaaatttaatagtgattgtactgcgctccgtaatattttctacagtttgtacgtgttgtgtttttcca

SEQ ID NO: 93 - DNA, 3000 bp, Arabidopsis thaliana
tgattgtgccattggagattctaagaggtcattcttcaaaaggaggtcagtttttacagtgtatttgattcttacaagaatacactatcgcatattaacttgtaagatcgtttatattaatgtgttttgattattttttatgactgcaggagtcttggactgcaagtttcatccgagacaaccatggctattcactgcaggcgctgactctattatcaaactctattgccactagattggtcgcaaaccatattttgacaattttcatctcttttcttctttgttgtattcaccacctttactcaaatattgtatcgtacaattttgttatactggatttattattgagatttctaacttgtagcacttccaaaatggtaaagtccaaaatcttattgtatcgatttatttggcagcgttggttaagttgtggcaagtccttaaacccaaatgttgatttgatagttttttaacgttcactcacaagcgccacgtcatcaccgaaatatctgaaatatctaataaaggcttcttctttcacaaatcccaaacctttttttttctctgctaacgaaaaaagccatcttctttgctactactaatctactattacactgaatcgtttgggttcttcttcttcttcagctgctactttgttcgagtgattgctgacatgccgtcagcgtcggagattgttgacaggtttgtttgtccgttttttttgtttttgttttcccgcttgtgtatgtgtgctaattgttcattgttaaagattttgtttttacaggattgttgttgtttttgagtggtatcaagttccttaaagtaacttcttttgtttgtttagtagttgaaagctagaaggttttcactttagggtttttggggtttttcgtagacagaaatttgttaattttgggcacaatttgtctcttttggattacgttctgtgcgatttgtggcttcgagttcgtgtggggttaagagacttggaaattagaggatctttagctggaataaacgttaaatgtggtacctttcctgagtttgctctgttctaattgtggtcgtgatggggtttctttttattcgctgtgatgctgcagattgtgaaaaattcttgtagctacttcggtgttggtagattctgtgatgcttaaaaattgtttctttgaaggtgctttgatcccaagtatagttgaacatgttgctttaaatcttgttaagagaaaaaatgggacttgcttctgtgcccaatagttcacgagcatgttgctaatcttgcttctatgcccaggaaacggaagtctcgtggaacacgagatgtagctgagattctaaggaaatggagagagtacaatgagcagaccgaggcagattcttgcatcgatggtggtggttcaaaaccaatccgaaaggctcctccaaaacgttcgaggaagggttgtatgaaaggtaaaggtggacctgaaaatgggatttgtgactatacaggagttagacagaggacatggggtaaatgggttgctgagatccgtgagccaggccgaggtgctaagttatggctcggtactttctctagttcatatgaagctgcattggcttatgatgaggcttccaaagctatttacggtcagtctgcccgactcaatcttccactgctgccactgtgtcaggctcggttactgcattttctgatgaatctgaagtttgtgcacgtgaggatacaaatgcaagatctggttttggtcaggtcagactagaggattgtattgatgaatatgttctcctagatagttctagtgtattgttaatcgtagttgactattgtgaggtcttaagttgtagattgaaaatgagatagctcatatggagctttattgaaatgcaagaaagtaaacaaaggaagatctttagattgtcaccaagagtggtctgaaactctcataacactcaatcctcctcctcctcatcaccaccactacaaaatattatattctctatctctcaatctatgaggagatgtattctatcaagcatttgaaatgataagaaactggcgatcatcctctacgtcaccatcactccaaaattatcctctttctaggtttaagttttgtaatgatcgcctttatttgttgagatctctaacttctcgcatttccaaaatgttaagtccaataactgcattggttaagttggggcgttactagtcggcttaaatccaaatatggatttgattccatatgtatgtgacagtttcttaacgttcatattacaatgaatgatggatccttgactagacaaagagaaaatggattgtcacttcgtaggaaaaatagaaattctccacgaaggctggtctcctttatttaacgacaaattcactcatagtctcattcacaatttgaacttgtctaacacaatgtgttatatactcgcgaaaagaagcataataggctcttaagggtaatccacgaaaccaaaacacatataaaacattaatatttttctctaaatttattcatatcaataataaagtttacaaaaaatataaaacaataatccatacttagcccatagcttcgtgtggaagaagacttgatttttgactagtcaacgaaaatgagtaaatgacgtattcagctatagtaaaagggatcataagcggaaattacaaagaagctttgagggtaaaatagtcaaaaagcataatcagaaataacttaggcccaaagcaaaaaggaaaggactctggatccagccgcaaatcagaatctggtaagttcgaacgccacgtcatcacctaaatatctgaaatatctaattaagacttgtctatatataaaggcttctcctttcacaatcccaaacctttctcttctctgctaacgagaaaacaaaagctatcgtctttgctactactactactactattattacattgaatcctttgtgttcttcttcttcagctgctactttgttcgagtgctttcttac

SEQ ID NO: 94 - DNA, 3000 bp, Arabidopsis thaliana
ttggtcggaacagctgttttctacctctggttcgatcctaagcttcccactttcagcctcgcttccttccgtctcgacggcttcaaactcgccgacgatcccgacggcgcgtctctctccgccaccgccgttgcccgcgttgagatgaagaatccgaactcgaaactcgttttttactacggaaacactgccgttgatttgagcgttggttcgggaaacgatgagaccgggatgggagagacgacgatgaatggattccgacaaggtcccaaaaactcgacgagcgtgaaagtggagacgacggtgaagaatcagctcgtggagagaggattggctaagagactcgctgcgaaatttcagagcaaagatttggtcattaacgttgttgccaagactaaagttggattaggtgtcggcggtattaagatcggaatgctcgccgttaatttgagatgcggtggcgttagcttgaacaagcttgatactgattcacctaaatgcattctcaatacactcaaatggtacaaaattatcagtaattaggattttggtttttgatgttaattacatccaaaatttctaaacttttatatgagattattaattattacgttgcagggtaactatacagtaacaagacggaaggattcgaggatttggaaaaacacgatgatctaacatctgtatacttgtaactttactgtagatatgttatcttctttcttttgtaattttattttttcgtgttttatactccacacatgttattaattttatttttggggtatttgatcaaattcactgaggggggcatatttagcgagtgtttgttttattattattttgtgtgagatagattattttgtgtgtaatattttatgtgggttattatttgggcagtaaacataatgtaatgtggtgatttttatgttaagaatattttcgacatgtttgtgtaatggtggtgggaaaatattgttcaggtggcgtatgaatctttagacactaatgggcccgtaaagtatatgggctgaaatgtttcgtaaacaaaaatatagatatcgaaatggtgtgccatttttgggggcctaaattggtaaaatgtcaagtggaaatgtggaattcgaaaaaaatggcttgtttttcagaattaggataagaagtccaaaaataacaaaattccattatatcagttaatctgtttttcctcatgtgtatcactacagagagatagctgtatctgtcattcaatgtgatttgtaaaaatgatagataatattttagatgtacagtctagttgagaatgtactatttttggtattatctatcgtacgactgcaggtttctgcaaaattctcgctatacagaaacgattaggataaaaatggatgtctagatcaaatgtcggagaagagagtcgatcactgtttttatcttgtttatttatatgatgcatgaactgcttcaaatgtgaagtaaattgttcacgatgtttattcccttcaactaaatgcaataataaaacagagagaaaaacatgtagacgataatacaaagaccatctcgtttcctacctacaccaactcatacctcgtagtataaccaaaaagcaaataataattaggttacaacaaataaatctcatgcctcaacgtccaacgcatatcgtggcaatttcttttgttatcgctttgtcttcaaggttgttcatgtggccctaataagataagtccaatttctcttttgtttcatatcttttgtttctttctattaatagattaatgcatgttaatgcacgccacatactatataaattaatttttgattatagtattccttatttatttcccgctacgaatctcttaattatttgaattgattatcttccgaaactgcttcgaaagacttggtatatattatgaccccagattcttttacaacaacttaccaaagaaaatgaatccacctagatccccataaaaatatacacaataacctgacctggtcagaaattcagtaacaaataaagagaaattgagtctatattatttttttgtctttctagtttatgacttttattatatcagatgatccaataccactataaatttgtggtaaatattttttatttctcatgataaagtgccaaaacaaaagatattgagaaaaattatccaaaatttgttttttttttcctttttagtgtccagtttcaaagctgattaatattagtataaggaaacaaaatatataatgtctgcaatcacttgatctccaagcaaacagatcataatttcccaaaataaaaacattcttaattcaaatcaagaggagataaataataacaatcaatgatctttcacaaaaactttaaaaacattccgattacatcattaccataaaattcataattatcatagtgggtcaaaaggagtgagtgacagtactgtgaccagtctcacgtgagagaaggcccgcccatttcttctcattagcgcgcatgaccttcacgaacacatataggcgcgtgtcatggtacaacaatagtcaaagttacttgtaaaccaagctatagagtgaaccaaaaccgaagctcttgaataccgaaataatccacgtgtcaaaaatcggagaagcggctagtcgtttgaagcgcccactaatctctctcttaattgccttacttaaattttcattaacagaaaacataattatgatacggctaaatctcggaaattccataacgataatttcgaaaatcaagaaggaaagtaagaaaaagccaaaaacacaaaaggaaataataatatttttgaaaaatgggaaaaaggaataaatgaggggggggcgtgactatatttaacaaagggattgttactaagaaacggcgttttcttcttccttcatagatagcctttttgactcttctttctctcttctactttttttcaggctctctctctatatctctatcttcttctccggttaactaaaagagaa

SEQ ID NO: 95 - DNA, 3000 bp, Arabidopsis thaliana
aagaagatgggatttcaccatagaaattgttaacagaaaggtagagaacgataagttgagaaaggttgccaatcgaagatggaatctgacccgaatatttgttataagaaaggtggagattggtgagattagaaagacctccaattgaagacggaaactgaccaaaaaaacgattaccagaaagacctagaaaggtgagatgagaaagattaccaattgaagatggaatctgaccaaaaaaacgattaccagaaagacctagaaaggtgagatgagaaagattaccaattgatgatggaatctgacccgaaaactgattaaaagaaaggtcgagagaggtgagacgagaaaggtttccgattgaattcagaatctgacccgaaaaacgattataagaaaggtcgagagaggtgagatgagacagattttcaattgaagacgtgatttgaccttcaaaatcattatgtgaacggtctagagtggttaggaaatgaaggtttcgaatactgctgttggaatgaaaccggccatggagggagctgcagctaaggttgagctcgatcacttccccggacttggcattgcacgtgactccctcccaattacaacagtcgctgttattcccccatgactccgtcttccgatgagattcaatgccaaccatcttacaagtaggagaaggcttcccaatctcaaactcgtttttgaacttgagaagtgcatccttttgttcgggacgacacaagtgcctagtaggagccgcaagcacgtccgaaaaatgacaaatgaataagaaagtaaaagaaagagtaatacgaatgatactcgttgagaccacccaagagcctttcatcctccttaatttacgctagctagctagtcgaattttcttgaatattgataaaagaaagtggagtttgtggtagtaaataagatggtttcgtgcccatctctttatagacatagtaatagattctactccacaaagataaatccaacacagcttgactcacattatataaccagtctttctaccaagtgttcttcacgttgaaacgaaaagacttaaaagagtcttcatgttgaatagtccatttccacacattttgtctttactttaattacgtacaggaaacttcgaaaagttgttttcccaaccaaattggacgacttgttactatgtctataagtctgatattattagttcagagatggatattatcaattttgtgcatcagtctgaaaaacaaactcgggctaaggcccaacaacataggaggataaaaataaaacgcaggcccatttgatcacattccaccgaactcagaagagtataagtattcccctttttgaaaagaaagaacagataacgtaagatcggttgtgtctcgccgcaatttctcttcataccgtcgtcaacatgtaacgttctgtagtccgcatgaaaccttagcaaattcgcgagcttcgatttccaaattatgggggtttaggccgaccgataattgaagaccgtgatgacgagtttgattttgtctcattgataatgcgtggacatttgctttgtgtttgatgattactgttagagacttagagttattgtacttagtagaagagactaattgtaaattaattaatgcgagctttggagttcaaaaaacctataactgaactagaatctcgttaattatttgtgtgtttctctgattttatgctttcaggataaaacactgtttgatgtgcttcgtatattctctcttagaatgaaatgaattcagaagaaaagtttgtgggtgatggtgataatcatggttgtgatgttgctttgtgtttgtttgattacttattttttggaattttggatgtatattattcaatttaatatactgccatactagaaaataaatattatagattataaatctacttttttggttataaattattcataacatactgttaatttgttttcctcaaaatatcagattattgttcaaatattgactataatctttaaaatgagactttcttaataattaagtttcattatttaaatatttatttcttaaaatattagtatggttttgtgattcttgagtcttaacatgtacatattgtattaaatatgtttctgtatgtgtttatcaactatagtaaggattcccattgcttacccgtattgagagcgtgtttttgtgtggtgaaaatttcaacacgtgtcgtcactggggaatgttatgatccacaattcgaattaataagtgccatgtcactactactctcattaaaatatcagaaatatctagacaaagttataaataccctttcgacctcttgataatatctgatttctgtaaaaagtttgttgtctttacaaaaagaaaagaaaaaagagacgctagaaagaacgcgaaagcttgcgaagaagatttgcttttgatcgacttaacacgaacaacaaacaacatctgcgtgataaagaagagatttttgcctaaataaagaagagattcgactctaatcctggagttatcattcacgataggtatgtttgatttccaattaatcttttctgggtttgtcgatttttcgctgaattagtctcgaagagggttttgggtttgatgaattttgggttttagatgttttcgtgttcattgatttgttcaaaatgtcatccttttaggtttcgctgtttttgagagaaatttgggaaattttctaatttagcgtttatttttttttacacggtttctttaatctaagactcgggttaaaaaattggaaattctaatgcgatttttgcttttctattaataaagtaaaacttggtgagcaagtaaaacacccttggtgcccaagttgtttctgttcctctttataactataaattccgtgactcgataatttctgttttctgaaattgagaggaagagactgattcaaaacctttttttttcctatcttgtagattcttagattgcgactataaagaagaag

SEQ ID NO: 96 - DNA, 3000 bp, Arabidopsis thaliana
cttcatcaactttatgtgcagcagcgtaacggtttaacaaaacttcgtacgtcttctcgttaacaaatccatctctcttagacatttcgtcgaacacttggtgaaactcttcaaatcgccgcattttcccaagaacatcgagaatctcgttatacaacatcgagctagatagatgaacagattgtttaacgaccaattgagaaagtatataagctggtttccaatcagatcgattccgattaaccacttctaaaacaagctcttcggttaagtctatcccgcacttatcgagaatccgcttaatcttttcaggtgaacttccacggtgatgctttatgatgttatgaacatcaagagcagattgcttgtctttgtcgtcgttgaatctatttggaaatttgtcgggagctccaagagaatgaagaaagtgtgtacccagaaagtggaacctggagagagtgatattgttcttatgattcggtgtctcgggaggaaaaacacggcgaaaatcgaccaatgatgagatccggcgccgcgatagagcactttgtagctgaaacaagatttcaattttgtttttccctcccatcttcactaaactctctaaagatcttccgaagcaaaacgttacatatacaacaacaaaaattgcaatgaaaaatacatatctttttaccaaaaatgaattaaaccggatttttttagtaaggttgaatgatcattatttgtttaagaacagcattatttgttagtgattgctattaaaatacgaatgataacaaattttagtatatgaaatttcattcgtttcggacaaaaaaaataatttttattgaataaagaatttatttcgattgaagtgatattgtttggtaccgaaagttttgcttacaaacaaacagaggttttgaatatagagacagcataaaagtgaagctagcttaagtctataatcatgtttaagaaaattaaacagtagtatcttcttaatgaaacgtaaagataatatatttaaataaatgaatctttttattttctgatatccagctgattctgtggcccaagaaacccaatccattatccatggcgtgaagacatatgtagctgtcgtaaaagaataaacaaagaccaattaaaaaagagccaattaacaaccaaattacataaaatttattaaaactaatctattaatcacacgtcttgttctgccgtcagaatgtaattaccgtccgtcttttaggaaacaaagaacaaaacaaacggcgggcccaccgccgttagaatctctctcggttagccgacgcggccaccattctctctctctcttcatccattctccacgcgtcgcgttgaccacgtggcactatacatctttaaaactctttctattttatttaaatagcgagtgcgttgtgggccatctttgtttttctttggcggaggggcggctaaatagccttttgtttttattttagttttattccgcgaaagaaaaagcagtcaaactccaagttgaatttggagctgagtctacgaagtcacgcataacgctctttctttcacgcgatcgccgtcggcacgtgtttggcggtgagattcacgctcgtacatggaaacgcggttcccaagccgcgcgtcctcaaggtgttgccacgtattttacatttttgcgtcatccaatactgttctttggtttcttcttctctcttcttttcaggcgccgctgcttaacttatttcctagtttttgaagttactcttgtctttaactcacactgccatatagtatgactttatttacctgtattttcaaatttttacacacataacagtatctttagttgtttattggtcttacaaaaaattgggtattttttaaaccaaaagttttgagatacgaaaacaaaattgatatgatctgaaaaattagttactcacatatttgttcaagtttttttctcaattatgcaagcattaaggttgatccaacaggttatgagaaaacaaactgagttcattacaagtgtactcactagagcaagcttgtgtagttatatcctaaatcatgagggtaaatggcacatgacaattcgtagttagattaactatatatattaaattaagatgtgggattacattcttaattccctcggttatgaaaatcaaaatcttatcaccagcattcaagggaatacgctgtgtagacaaaacagcaaacaacatgcatctccattaaatgcgtcaaatactgtacggatttctttagtttttttgttacaaattgtatcaaaagtttgttagtacattgtacatacagataacaaatgaatttcactttttagataaaatagtttacacaaaaaaaaaaaaaaaagactttgcatccaatattttccaccacaaaataaatcattcaaaatacggattgattaaatatgtatcatagtaagatctatatttcaaaatttatccttatttcattaagaactttaatgcaaagattacatagtccaattaattttctcattgccaaatattaataattaaattaaagatccagtgataaaaagttttattttaaaattaaagtcaatcaaattaatgtatttaatttgtatctatatttttgacaatgtattcaactttttaaatacatcaataaattcattaataagatgatcaacaaaaattgaaaacgcttggtgaggttaaaaaagaaatgaagggttgataagaaaaacaaaattctttgaaagaggaaagaaaaacacgtggcaaaagataagtggaggtaaaaaagaaaaccatgaaaaccgctggtgttttgtaagagaagccgctaaaaccatttcaggctttgactgttcacaacaaagcgccccaaaaggagcgtcgcttttactctctctcccatcctatatataaacaactctctcctttcctcttctcccttcaattatctatcacaccaccactctctctctaatctatctatccgaga

SEQ ID NO: 97 - DNA, 3000 bp, Arabidopsis thaliana
gagactatatgaaacaaatcagtcacggttaaaaaatctgcgaaaaaaaaaaatctggcgtaacataacacagtaaagtctgtggtacaaaacaagtctgttgtaaaaaatctgtggttgaccaacaaatctgtgatcgataacaaatccgtcgcaacaagagccacagatttaccaaaaacgacgatggcattttcgtaaataaatgtggttttattgccttgctggaattaaatagtaatggcatttctgtaatattgtttttctctgtaaaggaaaacaaggataatttaggtataattattactcaaataactcatatttttagcattccttttgggtcattatgtataaaatatgggttactctagtaaatttcccttttatttatcccctcgctaaaaccatttccaatggttgtttttatttattcttgtaaatatagaagaaaaaatagagatctgatctctattttagaaataaaaatagagatgggttagagtgaaatagatgaaaaatagattataaagattaaaaaaaagatgagttggagatgccctaagttaaacttttaactaccaaggctaccataggtgaattttagccgaagaatatccatttaaaaaaaagtagaattgaaattttattttaattggaagttccttgaggttaaagaaataaaattcctccgttaaattaaatagaaaatatagaaaatcaaatttctctgattttaaaaaaattaaaaaaaaacaaaaaaaatcaaaaacaaccctgaaattttgaaaagcccagcataaaggcccagtataaacaaacgaagacccaaatctttaacaaagggcaaacgagacggcctcccatatcggaaaaaaaaatcatattgtatatagaataaagcaaatcaacagagttagatataaacaatttttaatctttctccagcctctacttttcaatttgtctccctctaaatctatgcaatttacggtcaaaatttgagagtgcaacaaaacaaaaagagtaattttttcttgtacacaaataacgttaaattgttcggttaggtttctggtttttgagtttttctattcatctagtcatccaccgtcaaaataaaaaacggcgacaaaacagagcatgagcatcttttcctgtaaacgttaaccaaacaagtagtactactactattgttaacacgacaaaaacacaaccattggtcaatcctttgtaattattataacataatggaaatgagccgccctcgtgtataataatccgaacgtaacacacaagtcccggaatggaatccacaacaataaaaggcaataccgaaactacccttgatattatctttgtagagaagcttccaaagatggacaaaaggtttacgtgaatagtagagagggacaagttgggcaatatgggaatacgtatcatcatttacgtaaacacgtaaaagtcaattagtaacggtatccagccaccgactacataccgaccatgagtcccattatatgtcctcaatcctcatcaatctccttgtttatatatatagacgcgtatacgtaggcatatatgtcatgtaatacgttatacacatctatcgaataaacatattatacgtaaaaatcgaccattccatgttttttggttatagtttaaataaaaacataacttttatgatgttatcgtttactcacaaacaaacaaaatcaaactctcaataatacgatgattattccatcattatacaaagtcatatacgttatcttgttatattttgatttgctcttcattggtaaatatctgaaaaaaatatcgggtgaataaactatattatttttattatcattttattattcaaataaatttaaattaactaattagattatgtcaaaatatgtttgtcagaatatctcagaggttttaggcagagaaacgttctctttttccttccttttctattttttattattattttaattataaaaaacaatgagagataccattaatgaatccaaaaaaaaatctatctatatatgtatttataaatacttgaaaatattggatcctatattcaattatattgttctaaaaaaggacgagtatggtatctccactccgcgacttttctctagcttatcacaaacgtaattttctcatcctctatatctttaacccaattttagttttatactatagtctatatagtttcatgttttttttatatatagtttcacgtttttaataataactaaattttaatccgcggtacaccgcgagaacaatttatttttaaaagttagtatacataaaagtttgcaaattgtatctatctataaatatttttattttatagtttacaattgttattaagtaacgtcctgccaaacccgtcccgccaacccgtcccataaaaaaatcatttattttattaatgttaatcttatttatgatatgtttatgaattattgtttaaatattttgtaattttgtaataattaaatgttatcaaatatctctgcggtttgatgattataattgaattgttatagtcatggagaaaaatatatcaaaaatgataattttgtagtaaataaatgatattaaatattttggaagttttattttagtaactaatcgtgtagttaatgtggagagatttaaggaagattgttaaatgtcaaatatttaattcgaagattttttttctaattatcaaaaacaaacattaaaatccagtgatagttattgtaaataagtcctaactatatgatttatttcacaaaatggctgcaaaaatttcaagtttccaactataattcgaagtcggcatggacttttggaattttctcctctacctacaactgcaacctcggtctctttctctcttcacatatataagagagtcccttgatcaagaaaccagataatttccccaaacacaattctaaagtcctcctctcggaaagtaagagactcaacttccgagccgcc

SEQ ID NO: 98 - DNA, 3000 bp, Arabidopsis thaliana
gggtatagaatctccagctactttttaaaatacaaaataatgataccagagtacagaaatttaatagacagtagaaattgcactttaatttcgggtagaagatatcattaaactataggaaaaattgattaaccaaaaaaaggtcaacaatgctacaatacgattcacttcaaaatatttgtaatacactaccaaagctagatttgattcatactcacagatcttccaacgtctataactaaagaacataaacacatatatgacatgccctactgctttttacctcatcccttgtctcttttcttccctactgtctctttcatttcttctctccctttggtttaagccttttggtaatgataatcaggctgcgatactttgttacagcatgagcagagatgcttgacttgagagatgcttgacttgagttgcttccctttgttaacccgaagatcctctacatggttaacaaaagcataaactctaccacaattctcaaccgcttcaaggttagctccaaaatcttggatttcaacgctctggagagtgttcctctcgggattgaagtagaacacataaaacggtttacatgtatatttcatacacaaaacaatatcacctctagtagtcactccagcaactgaaaagtcgcaggaatcaaggacttcattctccggcagagtgtacacatatttaacccattcatgcttctcggcatcctctagaacccacatacgcaactcaacggtgcgcctttcaccagcttgaccatacttccaattaatcccacttaatttaccctcatagtttaccaaaatcaacccactagtatcatcaagttgatcattaaagcatcctgcgtcaaaatacttaaattcctcagaccttacatcaaagcaaatgatcacacaagacggtacaccaagagtctgagctaagtaatacaaaactccattgatacatattccttcactcaaagaacgatcatatgcaggacaactaatgatattactcctccagctcagttcctcagttcctaatgtcagaatctcatgatgttccctttgatcagaaaatggataagcctcagacaataccttgaattgcttaccaatgggatcaaaccctagaaagcctcgagcatttttgtacctcatcagatcaggtaagctctcatacattcctgtggtagggttacaaatcacaggcgatgcatcttttgagagccacaaatcagggaaacagagcaaacctgagacatagctacaaatgaatcggcttacgtctcctgagaattttgtatgataatccaaatgagaagacttctcatatcgattctgtggctgcggcgacgagaagaagagccactcaccatttcgttcggcagcaaacagcagacgtggacgattcgaggatctggtcaggaagagctcggtgaaaactggactgcgaagcatagacgcccagtgcttcgacaaggtacgaaatccaatgactgacttcgccggcaatctcgagaagatctcgagaatgagatcatttgggattggttccatgaagaagcgtttattgccgccggagtgtgtgattgtttcgtcggagaaggagaaggtttaatacgacgcaacaagattgggattgtatgggcctttgggctttagcatagttgtgaatgagctaagcccatttattcattgcgataattgggacttttggtttgttctctcacgtgccaatcggtatgttagatatgtggtagcgaatgaaggattagttttcacagggattctaaatatcatgtaaaatgtaaagaccaaatatgttttggtaactggttatggaatctctagctactattagcaacaaaaaaaaaagacagtagaggtagagcttgctttttgatttaggatgaagaacaattgtttaatggctaaagcaaaagcttagtatctggtgacaaatgtgtcaatacagagataaatttattaggcttagcactcctttttttggattaaacaatcaataaaaacgaaatagaaatataatcagtttgtgtttttgctttagtgaaacagaagaaaatgggttcagttattactttttctttattttttgggatttgtgtagaattatgtacaagtcatatactattaaaataaatgggattagggaacaatgtggtgagttaaatgtgatggtaagagaggaaggaagaagcatgggataatggtgaagggagcggcgcttaaatctgaaaatctcgagaatgaagaaaacacgtcacttcactctcacgatcgaacatgtgattcttgtgtgctgcgacgactcgtgactcttgcctctctttttctcatgcatggctctccgattctccgacgaaagaaggaaacaacaaaaagataaagatgagatatcgtaaaagctttaaagctttaaagtgtcctcaagaaaaataattctaggaacccaaaaaaccttgtctcgctagatatcttggtaacatgtacaagtaaaatattagagctagtcataacaaagaaaaacaaaaaaaaaaacatttgagttcctgatgattaacagaaatttttgaacataataatccaaaaaaaaaaaaaatgtgtgtgtgcaattgttctaacttcttaagctatcatcaaaaaggtgtaataactaataaggttggcattgcgactgtttggaatgcaggggacaccaagaactagggattatattattctagtttgagcctaggtagaagaattatataaatatgaagttgagatcaaaaatggttaaaagtttttttttttttttttcttttgaaaataacagaatatgagaaaagcaacggtcacatgcgcgggtgaaaaaagcaattctctaggaattgaagcgaaccgtgacattatttaagcactcacatactctttctaagctccattatcatatcctcttcttccttcttcactatcaatcttcttctccactacaacacaa

SEQ ID NO: 99 - DNA, 3000 bp, Arabidopsis thaliana
tatagtaaaatgtaacctgtcgaatttctgtcttctacgatcaccagtactaaactgagccatactatactcacacaacacctaccaaaacatacaattagcaataagcattccatattcaccaagaacaatactaaacaagatcaaagcatatacataccactgcatggtcgttcttcttttgctggctcttgttttgaatctgaaggagcacattaacagaaataaccaattcgctgaattatacaattaaagtatcaatcttgataggtgagtaacagagtaatcaagtacctctcttggaccataaacagctgcaattactttggtattacccatctcgaagacagcagaactggaaacaaagttggaatttttgttcatataaaagtgccgaatatagaactgagatacggaaaaagataagagacagattttgagttttacccgtcagccttagaaacaactccaacttcagctacgatttgcctcatctgagattcattacaagcaatcacgaatagaccgattaacttgtgaaggcagtggcttacaaagacagtgaatagagatgcaaacatacctcgttgaatcggcgaccatctaatcgaagaccttcagggtttacgtactccattgttgtgaactctaggtagagataatcaaggatgagagcaatgaaagacagaaacagaacaagtttaatactttctgatcccacagaacagggaacaagagacgaatttacctctgccagtactttagcggcggcgatatgacggagggcgatggacggcgtcgagagaactgaaagagtgtcgacaacataaagattagggctttttggttcctttttgtgaattaagtgagattttaagggtaaaaccgtcaaatcacaggaggatttttttttataacttctagtttatgaagccaggcaaattggtaattcgcttgcaaagaaaagtaaagctcaaaattgcgggaacatgcatgcaataagagaattaagagtgagatcccttcaaaagtatagctcaaattgttgttgttttcttttatcaaggcttttcttgttgactctgttatttcaagtatgtattagtaatagtaatatagtatctagatcaatttctaagtcaatagtatattgatagtagtatcaacgtgtcgggagttacgtgtggcaatgccgacaaatgaatgcaaagtgaggtatatgaaaatgacgggttcctgacggaggagatgatggaattatttactaaggtttgctaacatcttctttttttatgtatgtatgtttggatcaaaaagtatacaaaaccatattagacaatttaagagagaccactctctagtctctacctagtaaaagtagtacctactacgactatcctaacgaatgtcatgcaatttaatgttccatatacaatttttttttttttaatatattaaaaacaacccaatagggcatgggctaagacccaatacacagatgaaatccagttacaaaataggttaaacagaaaaagtcaccgacaaacaaagaggttcgaaccttgctgctggtcggaagcagagtggtcggagccttatatctggcggactcaagcatcacagctttgcggccgcagacgacggatcgagaaacgcagctggaagattccggtttccatctgcacctatctccgccgtcgcaccaacccaccacaactctcccagaaagctaaccactccgacttaccggttccgcgatatctgttccatgccaagcaacccgatacactagagtttaacccctctccgacttaatgttccatatacatactactaactattattaaatcaaactgactgttatttttaaggtctaacttttaacacgagtacctgactaatcccacgtaaaaaaaaagtcttgaaatcacatgtatctttttataaaatcacaggtgaattcgtgtaagttatataaggttcaaaataaaacaatatagaattactgtaagttacaagatttggtatattaacttgtagaattatcgatataataaaagcttatttttcaattattattttaggaccaaatctagtcaaagctcaaccattaactatggaaatctaatttctagttacctttttaatagtagctttttctaataaagtttctgataagagacttggtctccaagcaaaagatcataaattttttccgaaattaaaaatatattttaatattaaagacgagattttattactctttcaaacacatcgttagattcattaccattaaacttcacaatttccatattgggtcaatgcgaattgacacatactcgtgaccaatctcacacgcgtggagcccactagccggcgcgtgtagcaaacgtaaaacagaccgcgcgtaaaagagttaaaagttgcttggagaccaagctatagattaggacaattggctctactttcggtacggtaactaccacgtgtcataaatctaacgtctcaatctgagatgcggaaagccgtttctggatcccccattggccgccacgaaaccgcccttaagcatcgtccctctttacattaaatccaaatctaattcccggtttataaactccattaaccggattaaatttcaataggttaagctttgataaacgtatgtcatttcaccaactatattttaagatacgtttagttataaggttgaatgagttttgattgggtcagtgtctcatatcatatgaatagtgttgaacacgcatcaatttctctgtaacagttaaaatctaattaaattaattacatagaaaaaatcacgttactaaacaaaaatctccaaaaatagtgatgagttaatagtatttaagaaggatgttcctgagaaacggcgattcttctttaaccttttgactcttcttctctctctctctgcaaattcaaaacagtgaaaaaaacctctcttcattttttaactccctctctctctctctctct

SEQ ID NO: 100 - DNA, 3000 bp, Arabidopsis thaliana
ttgctctgtacagagaatatcccctcagagtttcataagtcgagttgtatcctctgctatccatcttagtaatacttgagagcttccttaactttgcaagttgcaactcaacctgcccaaataaaaaaaaagataatgatttttgcactgttctcattgaaaagggtgaaagaaaacagattcattagcatataatacaataccttgcagagattgcctctggcaacattgtgattcctttcctgaaagaaccaactgtttgggccctttggctttgacagaagcggcctcagtttcccattccacaacacaaacctgggaatgggaaacaatatctacctgaattacgcacacaacgacaaatgtaaatccactaaaccaaaaacagagcttctaccaaaactcttctagtaaacttgcaaacaacgacaaggcttaaatccactaaaccaagacagagcattctactaaaactcttttagtgaatttcaaaccactaaactatcagatacaagacaatttgttctgtagataactaatttttgctttcgaaatcatatacattggctcaatttaacgcttcatgtaacaaaatcgaattaagcgaattcgatcgaaaccacaataggaaaagggaaaaaaaaaaacatttttcctcgcgtgtcaagatacatactccgctgaggatcagtcaatccgccgtcacggtaatacctcctccgccttcgagtttagaagatcgacgattgatcaaccggaaacaacagagattagtagaatcataagcaagtaaccgaggacggagaagaattatgagagaaatggctgcgacaccgccggacggagaagagacatttgatatttccatggcgatcgctacgaaaagaagaagtagaggcctgttctcagttttgtctaacatgtttcactcctcattgatgggcccttaataaattcatatttgggttaataacattacatgggctaacctaaaagcccagtaaagataacgttctatttggcaaaaaaagaagaagatagatagatcatagatgctgcatttaatgtacaacaaaaataaaaatcgtcaatcaaccactagatacacaaatagtacttcgtatagtatatgattccaaccaaaacggtgggaacaagagaaaaatattaaaataagaatcaataatgcaaagtttttccataatatcaaatagattgaacagtgggaagttgtagattggaacgtatattccgagaggtcgttgtcgtgaaggagattggaaacctatgtagtggctgtggttttgcttcgtcgctcgctaagacaccaacaaaatataaagtacccaagtgtcagacatagcaccatgtccatcacgagggcatcacgtgaacacgccttttcttcttcctctctctctctctttttcgatttttttcaggcccatttgattcaacgctacaaagttaacattcattagtcaattgaataataataattagtatttttgttctactaattcgaaattagaatttgatactgtttttttttttttttgattgttgatatttagtaaccaggtcatttttgtttattcagaatatgttgtaattattggagttttttttaattaaggaaaatagtgtggaccttttttatcaaagatagtaataatgtggaccatcgcacctgctcggtgtatggttgatgatgacgtgactctaaaattccaataaatgtgtcgtggggttacagaaaacaaaaaaaactgattcgttataggattggtttagagcccacaacccacgtgggattttggataaaaccctaaatgaattcttttttcaggaatccataaatggtcatgaaatgaaatgcattctcaggctggaaataatcgaccattatattattgcacaaaaaagtgaactctagtatcataactctgaaattattatgattgctggttactgaattttgtaagcctttcataataacgaatttaccaattgggagatcgaataatcttatcgttgttacagacgatatttttttgtcgattatattatgaaacttgtggtagtcaacctttttttttccaaacggagacgtcatctttttgtttttatatttagagatgatctgaccaaaaataaacaaatagacatccgatattttacattgttttatatatatataaagataaagcttaatgacgagtattcaatgataaacgataagattacgggaaaaataattaaacggataaaaatggccctacccgttgtgcattacagttcttggttaagaaatactattaaactgtctctcaaatctcaatatataaatgaatacattctatacgtacaaagataaatttatctctatgttcatgtgtcaaagtggtagtgaatctagtgacgttattgattaatcaagattacttttatctttctgtgcaaaatttcaagattactctaaagtcgatatatgctactatgacgtagttttgggacaattacgtatagaatcataaaaacaataagcagaataataatccatttaagtacattgtgaatttgtgataatggaattatttgacaatacttttccaaaataaaaactaatttaattactgtattaattattttagtaaaacaatattttcattacaatgtttgttgtgaatccaaaaaagtattgtttccaaagaactcaaatgacatcaatatgtctataataacctcgtgtagctgtatgttagaatctagccgaattgttttattgttgtcggtgtacgcaacaaacgaaccacacatactttgaaacgtggcacaatataagtgggtcaccaatgtagctgacaactataccatctatctgatccgatcgctcttataacataagcgtatgggataccattttctcggacaaagctgaaatccctaaagaaaaaacacttctccaaacttttcatctccgatatctctttaactaac

SEQ ID NO: 101 - DNA, 3000 bp, Arabidopsis thaliana
aagttcaatttgttttctaattgttaggttttctttttgtttgttttatactagatttacaaaacgatatgaaaactaacgagactttagatcccgtcatttgacatagtcatttgatcgttagcaattttataagtttaatttgttttctatcgttatgtaaatttatcattttagtttagtatagttttgttttaaactagatttacaaaacaatgtgaaaactaaccggactttggatcccgtcatttgacctaatcatttgatcgcacaagttcaatttattttctaattgttatgtaaacattttaattttgttttgttttatattagatttgcaaaacgatatgcaaactaaccggactttggatcccttcatttgacctagttatttaattgttagagattctataagttcaatttgttttctaatcattatgtaaatttagcattttttttttttttggtttgtttcgttttgttttagactaaaattacaaaaaaatatgaaaactaaccggactttgaatcacgtcatttgattgttaacgatttcttaagttcaatttattttctcatgtaaatatagcatttaagttacttttaggaaaaatttatcaaacgatataaaaattaacgggatctaattttggatttcgtcatttaacctattccatttgatcgttagatatttcacgagttaaatttgttttctcaatagctttaatactcatttttttttaacgattttttaaattacactttcaaattatttttttatgctctacggatttcatatacgtttttttttttttctttttgatgataatgaaattaaacttataatcacgtgttaaaaaaaacagagttacctcgcgaaattttttgatataagaacagagtagtagctagaaaaaccaaaccttgtgtgtgttcattggcgacctattcaatgctttcatgagataaccaactatggaccaggaacaaaaatacttatacatattttcataaaccaaacataaaagcttcatctcaaagacgaaacaacttaaagaacacacaccggtttgtaagaagcaataacttgtccgattgccagtcataacaagactccagagccatatcctattgccgctgctttccagttcaacaagctttctttatttgtcggttttggttgttgtgtctgtggtgttcactctttaaactttttcatgtttttcttcaaactctgaatgcacatatccatttaacaaacgacgataaatattcactcttcaaagtttttcttgttttattctcacttcaattatgagataatattgttgaccaaaagaagttgttatgatctatttttcttctttcctacagggagaccgttaaatgtattcttgaacttgggcttcgtccacaaaaacatgccaaaagagaaatgatattgttgaatagtaaaagtcatacaactttcggtttcctttttctccttccctcttatcctcttgacagtatatctacgcaaaaaattgtgtgttattatacatatagaaagaacaaaagaaagaacgaaaaggaaaatggaatgtgctcaagtcccaaaggtcaaacaaagaagtgtgaaattgaaagcgaaaggtgaggcttctttcttgatacacttgttttgtttgtttggccaatgttcatcattcgccccttatcacaatcacacctccctcttcccaaacaaagccttctttcacctacttctctctttttgtttctaacaaatattgatttttttttcttgtaacaaatacttatgaacttgaagaaaaaagatctacttattttagggttatattttcagaagcttgaccatacacatgtttgaaacttgataagtaaaagaggagaaaatcaaaaggaatttgtttggagatagtatgatttatctttcaactggaaataatcattagattccatagattttgtatggaccacaatcccatcacacattccaaatccttctttgcccacaaaaaaaaaaaaaatggctggagaacaaacgatacacataacagatcatatcaaaaataaggatcacatcaacatatagacgcattattattatgttctatcaaacaccatttcaaagaaaaaagttatttgtatggcgaaagaattacaagtactacacatcgtgtaatttgtatgatgaagaaaagtaaaataaagtgcactaggaacaaaatttcacttggtgaatcattttgctggccattagagagatcatatcactcgaatgttttttccacattattaatcccatgccttaaaatccaccccccacactactaccctaggcctagggttgctaaaatgcgcacctagccagcgcacgatagctctgataatattaccaccgttgctaaaatgagccctgaattttcttcaacgcccccctttaaaaaggagatgtctttttagcaactctgcgtttctttctctctctctagtcacttgttgttcttactcaaagtgttcatctctctttcaccggtggatttctcgacaaagattctaactttgagagagatttttcggttgtagatgcagattcagagcgtatcatctctcgagaaaggatcaatgtctcatgaaataagctagactctgtttctgttttcttcttcttcgatctcaatttcttcttcttcgagctaggggttgtttatgtttgggaaaggaatgggcactaggcagtattcactgggagaagtagggccaccaataaatccgagagctggattgcgaagggaacaagctggtagaggttcatacagaggtagttagtagattcgtagctcatctgtaggcaaaaagggtttccttttaggtggcaagactgtttattttcagacacagagactgattaagaattcaagggagagttcttgtcgggggactattttaagttttaaaaaggggtgttttttagtggtgaaggggaaggtttag

SEQ ID NO: 102 - DNA, 3000 bp, Arabidopsis thaliana
tataaattttaaaataatatgtatgaaattgaatataaatattcaaattatgacacagtactcagtaattttttttcttaaatctacttttgacccgttatagtatttttttcatgtactgaacaatttatattcgtttttaaaaattcaaattgtggcatatgcgaaaaaactctaattatttttttataacgatgatattattttttcgcaaaaatagaatcatataaagatgagaggtgaattataataattaataaaaaattaatatgataatattgatatcaaatctaatttgttgattttaattggttacttttttggaaattaataatgtatttcgtttttgagttaaatttaattaattaaattagtatttgactttttaatttttaaagaaatgaattaatttactctttaaaattttatttctaatggcatacgtatgtaattacttacaaaaaataaggttacattttaaaaattaatatgataatttagatatcaaatctaatttgttgattttaattggttacttttctggaaattaataatgtatttcgtttttgagttaaatttaattaattaaattagtatttgactctttaatttttaaagaaatgaattaatttactctttaaaattttatttctaatggcatacctatataattacttacaaaaaagaagattatatttcaaatgtacttcccaaataatatagtaggatcacttccattccgagttttcttctttctttgatatatatatctacttatttatttactcggtttgattttataataaatttgtttataattattttctgaacaagagatggccataaaatacagtgatgaaatcaataatggtccatgcaaatgtactcaaattatccacttggaaagtttatagtatacaatgggttgttacgtattttagaatctaatttgcatggcgatttaattgacatttcatcatcaaccgagctataacgagagataaaccagaagatgcaacgttcgtgaacaaactcgactgatattctagatggttttatttattttttacttatagaaaggaacaaattagatttaaagataatatgctctaatctaagagtttggaaccactataccacatactatatcccatgattaaaaaaaatctcaattattatagcgcaaatgattggttttcatcagttaatagaacttgctgagtgagtccccaaatttgaggatgattagtaatttagtatcgtaaagactaaaaaagacttaagaaaaatagtaatgattagagaagtcaaacctttaataattaagatagataaagagagacaaggttgctcaaccccacttggagtgtgatgcttttttggcagtgttcctttatgataacacatctcttcacacacaactttagtgtatcacaggcccatgtcactttaagataagataacatattctagtatatgattattttcatatttgtaagtgtattaaattattcatagacacaccatgaattaattgtaataatgcgaaggacctgtatcatgtaacagagacagacgaagtgtgcagaggtcggtgagaagcaatttggtcaccatgctccaactctcttctctaggtcccttttgctttaattttctcgtttaataacaatatcttatgaaagcagttaccatatcaattgaaggattgtataataccgtaatttatttatatatagtacatctaattaaacattaattatttctactaatagcctaaaaccactactaatacaacaactagtacttgtttacgataattattaaacttgtctcgatacctacaacatgcccaaaaaagtaatcaatactttgtttaatcacaaagatctcagtgagatggttctatagatagtatttctgatttgttagtatattagagaattgaccatctattaaaataagagaatgaacactatttgataaaacaatacatacgcaattatcattgtctttaatttttatcaaagtaatcatacgatcgactatttgtatgcaaaaattcatcattttatttgcaaaaaaaaacaaacaaacatggtagaattgtatttggtgtgtgttttaacaaattgttgcaatgtttagtgcaacatatataatccactatatataatcattgacataattaatatttgattatatgaagcaatttctctttaattatgtgtttataaatatagggagaaaagaaaaatagagagaaaggtaaagagtagagctaatgattcgggcgacgctaaaaggttgaatgttcgagagaaacggagtctcagagactgtgaaaacaaaaaatcaaaatcctcagttacagacgatttggtcccctctcttctctctctgcgtccgtcttgtgcgtcgatttgtctccatctccttctctctccgcctactttctcaggactactccaattcgccgactttttctcctctgttctctgcatttggattgatgccactttaatactttgaggttctcactctctctttctctcttcgctgacttcgattgcttcagtaccctttttctcaggtcagctacgatgatagctttattcagacaagaagatcaaagttttgatctttttgttttggttttcttaagagatggttaattaggtcttgagtgcgctgttttgaatcgttcttcagtgtgattaaacaattggttttgatttgactaatcatgttgccattaaactaagtgaaaatctctgctttttttatattgcatattgatgattgagacattgatttcttttctatttctttatttcccagtttctaatttgggaactgaaaagttttctaatttaagcattacaaagtgtacaatttttgtttctggcaagtttttcttggcctaattcgtctattttatgaattcacctttttaggatcaagacttcgtaaaagattgtttctgtaaaacgcaacacc

SEQ ID NO: 103 - DNA, 3000 bp, Arabidopsis thaliana
actaaaataaaacttctaaaatatttaatatcatttaattactacaaaattatcatttttgatatttcttttctgcatgattataattatcaaaccgtagagatatttgataacatttaattactacaaaattacaaaatatttagacaataattcataaacatatcataaataagatcaacattaataaaataaatgacttttttttagaggacgggttggcatgacgggtttgacagaacgttacttaataaaaattgtaaactatacaataaaaatattttatacatagatacaatttataaacttatatatatattaatttaaaaaataaattgtttccgcggtataccgcaggttaaaatctagtttactatataataatactcacgagaaacagttactattaaaatatatagtatctgattttgatgtaacctaaactttaagataaacaatgcgatggacagctaattgaagataaacattacaaattaaaaaaggattaaatatgtttttggcgtgactagtgggattcctccttctgcacttaatcttcatttcaagctagtattactttaaccatgtaattaatttccagattcattttttaaaaggaaaaaagaaagaaaatacaactaatatcaggaaaaatatattattacacattcacatgtagaaaaatttcaagtctatatgatcgtgtatttgtgtctgcatgtttcaaaatcattgaaaagacccttcctaaaaagtaagcgaatccaaaattgtatgtaaatttatatacatatgtatatatatgaacatatgttattataattatgaataaattattgctacttaggaactcaatcaacaaaagatacatagattgaggcgcttctacaaggtcatcctagtcacttattaacctaacatatgtaacacattgtataagctattcgagcatgccaaatcaatcaagatcattatatcatgttcgacgatctatcgaaagtgtacaccaattgatgattctctatttctctaaatctaagaataactcgaattggtcacatacaaatttggatcaggtaacagatatatttttatttcatgcagttaggaaataacatatgggaaatttatatcttacgttccacattgttcccgaatcccgactaatgtccctctctttcaacaaggtgatagtaagatcttcatttaatcaacccgactctctacttaaaaaatttcaaccattttctctaagaagtcagaacactccatcatccccattctaagctcaacataacaacataacaagaaaactgtcatctttgttatctcatttctcgaagtaaggggggaaatctctatatttatcccactaattattcattacttagtgggatattgttgttttctagtggcgtcacccccaaagtcgacatgaaatatgatatcacgaatcacctagccaaaacttagtgtaacatcttctcataattttcttatagtaaacatgttcaaaagtcgactcacaaccaccagacaatggtttggttgttttctgtttgttgaatcgttcattgacgagttcacccaatacagatgtctcagaaaattatattcaaaagttattttggttgttatttacaaaaaatggtatactagatcccaaaattattttactatttattgttggtaaaatactctttagtttaatatggttttaataagaaaaatcaaccggagtatcattaatctgaacgtataaagacatatcattgagtttatcacaagacaacgtaaatctacaagaacacaataacataagtttagtgttttgttagtaagaatttgtcttcgcaagatagaattttagaagtatatatatatatatatatatatactattttatcttaattctttttgttttatttttggtttttaggtaagggttaggagtaatgggaccatattggtggcatgctaaattattgtgataaatttatgcatggaggaaaagatgccaaatgatttatgttattcactcatactcacctaatgacctaatccttgaattattgttcgaactttaaaaataaaattttaatattgtaaattaaacaaacaatataacgttgttagcatgtgtttatcgtgaaatgtgaatgtaactaaaaatattataaaggagttcttcctttcttaaagcatatgctaataatagcgtttggtcaaattaataaattattagtttatttagtcgtcaacaaattaattagttaagcagacaagaatcgtttttggagatagagattctcacttgcatttcactctcttgcaatttaacatattaagacaaacacaaatttttgctttagtgaattattagcaacgactcacgttatatagatatgcaaatctcaaaattaattaagctaagacacagtatttgataattgagattacaaatcttaaattttgatttttaatattttaaaataacattataaaataagtaattaatctgttataaaaaatatattctaaaagttgacaaaacgacaaatataaatcgaaaaaataggtgaaaagttatagtaaagtgtttttccactgagctcacagttcactctttggtacaaaagaaacaatcagttaaaatctaagtcaatcattaaagagcgtgtgatacacgtgcgaccaaacagccgtacgatctcactcacttccggtcttaattcttaccgcgtcgatccaacagtcgatggggttaaatcgggatgtgagttcatcgaagcttctctctctcttacaaccatccacgtttcccaatgaaatctcgccacgtaatatccctaacaacaaatttacacattcaccctcaagatcagttacacatataataatcgcagacgctctccatttttctccactacgaagactttctcctatctctctctctctcattaaaaacgtgtttttttttaccggtcaccggtttatgga

SEQ ID NO: 104 - DNA, 3000 bp, Arabidopsis thaliana
gacatatgtggtattgagaaaagaatagcaaccatgattcacttaaagaaaatgagttattatagttatgttatgcgcaaatacaggtggtgataccatatcggtcacaaaaggtattgtaacgagagttgaacctcaaaagtattctcacagctccattaaaatgtatgtatataccagtggcggatctacaaacaagttttatagcggtcaaataaacaaaaaaatttatgatggacgataaattaaaaagttatatcaactaaaggggtcatttggaagttagaacaaatttataggggtcaaaccctaattttaaccaagtattttttcaaattcaatcaaatttacattaaaaataaactaatatgtaaaatttataggggtaaagaagagaagaagagttgtgaaaggagaagaagtggatgagttaggttgtcgtagaagaaagcagaagatgaagcaaaaagatcattgggccatgaatcttattaaggcccataatgctaatgggtttcgatatttaagttaagaacaaagtagtaagcctaagctcattaacatttcagttggtttagtgagtttattactttggtcgaaatgaatgtacattatatgtgttcattgaattataagtttttaaaacaaaattatgcatgcacttttctaatcaattgtaactacactagatattgacctgaatatagttcaatgaaactgaaactgttattttaaaaccatatatagattaatcaatgcatactaagatttcaagaaaaagggactaaatgtgctgaaaaaagctaaaaccaaaaagactttttgaagacattttttttataaacaataagaaagtgagaaagattctaaattggtggcttactatttctaggaagaggatcttcacgcctaagttccacgtgagattgtgcttcttctgttgtattccacctcgattctcacattctcaaaccttatcttatatttatgggtattgttttctttgttccaaagtaacgagtactttcttgacaccaaaatgtttccttacaaacaaaatatagaaaacgattagaatttatatttagcttttgctctgcagtttctattctatgttaacaacccagatctaaaaatataaaagttgctaaattcattgctgatttaggattttaaaaatactatataacagcttcctgaattcattaattagtttgtgaaagaaatccaaaatttgtttttttcttgaggatatcaccaattttttaaaactgaagtacagatagattacaagcgtttgatatttttaagtataattaacgcccaaggcattaatcggtatcaaactattttgctgcataaatattttgttttttgatccactaacacaaactgttaaaaaaattaaaataattcattggttggaattgaatctcttactacactacaataacgtttagttaaaatgacgctcaaattactcatacaatatttttcttcttaattgggcaaccaattataaaattatttttcaattaatatgtgattaaaaaaattactcatgtagtcatattaatttgccgtgtaaaactcttgtttcatggattgtaactatggcccgactctgattatgtcccttaacatgaatataagcactttatcgatttgaattcggtttggtcatggccggccttccgcataagccacataagcggcagcttagggtcacatttttttcccctttgattttaaggtccacttttgatgaatcaagaagttacattgcactaccatgtcatatatattcacatttctgattttttctacacatatttatataagtatttatcttttttctattaaccagtttgtatttcatcgaatagcaagaaagttcaatactattcgactctcaagtgtttttccaaatcaaacacgcaaatacgacatattaattgaagtggataatgaaatttgaattcggatatgtattagtagttgttgttatgtacagtattttgtagattaaatagcacttggtctttaaactttaaacaagtactagtattatacaaaaacgtaagtacaatacgtgtcctatattttatgcggaggtacatacgtgtttaaacgtgaatagttggattaagtcgcttgaaaggttccctaaaatttggagccctagactgccatatcaacaacacctgtctgatcctccaactattttcatttcattttattcttctttttatatttttggattttatttatttttttataatttattaataaatattatagtttgtttttctttttaagttatccgtcatttcaatatacgtcatatcgacatatgtcctttttctcagccatttttattgctttataagtcaacagctttaattcccacaattatatatagtcgtcgttttattttattaaaagttctgaatcatttcaataattgctgattttaaaattcatttattaaaattaaaaataagataaagtccaaaaaacattaaaaaaaagctgctgatatttttctttgaaaaacgagaaaaatcatttaatagccacactgattggaagtataccaaatttacaaaaaataataatcacatcgaaaaaaaaaaaattgacatcaaaatatttttctcgaaaacaatatttatttttcactgttacataacattataaaaatgttaacgtggtccccacgtggcctacacgtgtcagcatcaagggttccactcgtaataagaagacaccataaagggtattttagtcaaatcacaaataaatcccaatctctacctgccctctgttgtttcttcctctcctcttctctcttgcacataagtttctctcacgttctcttttttaattttaatttctcgccggaaacaatctcatctcccggcgaacgaaacttccggtgtggtactgcaaacggagaaaaaaataaccaaagaagagagaaactcaaaagctactaag

SEQ ID NO: 105 - DNA, 3000 bp, Arabidopsis thaliana
ttcattccgtgacgtagacaattagttcattttcacataagttacgtattttccacgtgcataatatatttgtatgtgaaaatgaactacatggtgttaatagtgaatttgtaccgtaatgggttgctgatgggccacttttgcaaaatgggatgctatttgattatcgatcatgggatataagcgaaatacaactctgccaaccgggtcagccatattcaaagtcatccaacatgatttctagatttgcatcccttccttggatttagagaagatcattataagcattgcagtcacctgtcaccttccatgattatcagcatatcacaaacaagagaaacaccttcttcttctaaatcaatacttgcttgtttaagttttgaactagcaaagataatgatgcattttgttaagcaatgctgctcatgttgtgagctagattagctatagctgtcattatatttacaattaaccatcccaaaacttcttagcatcattgtaaggacgccgttaaagattgaatcatttaacgacttctaattggtctctatataaacaaacaaaaaacatgtcatagatgatagatgttaactatgattttcatatttctttcttgatcattactcggatgttaatcatcgagaatgtgttggagtgtatttgattcacatatagatgtacttatataatacaattatgtttactttaaatggaaactaattctttttcttaacaagaattgagaaattaaaaagataaagataaaagaaaaaacgttgttccgtcgcactttaatccatctgaaaagagttgagttaggcggaacatggtacggcgatgattgcgtgatgctcacttactcacgtagttgtcgggaatcatcaaggacacgtgtcgaaatgtgataggagagagacatgggcggtactgagttacggaatagaagaaggaaggagaaacaaagagctttataggtgaaagggaagcctaacgaatatttaacataagaaatggtcacaagcaagagtttggcacaaactactattccttttcctctcaaccataaagctgaacacttaaataaatttatatgttatattttcaaccaagcaacatttatcatataaattatcaacgacttaaagtatttatcataaatacagaattattttttttttcttataaaattatacaaaacatattaacgaaacgcctataacgacagattaatatgtatacttaggagtttattagaaaagttatacaattaaatttagattctaacactattgatgttctttagatatccaagtggtttttttaaaagtctttagcccattgatcatattcgaataattttttagttctcaaagtatgttttatagccaaagtttagactaaacattaacaagatattcatgtggtttactgcaatttataatttgttttaagccattttagggtttagttcaacgatactaaaataatacttttctattttagactatatgttatttaactaattaagttttgaaaagaaacaaataaaatttccaccttactctcattaatatattccatcatttcttagattggttaaatatattaaagtaatagattataaaacgagatatttcgttaaaaacaattgcactaaaataactataacgatattctgaaacaaatataagcttataattatgtcaaaaaaatttgtaagacctaaaaggttaagtaaattgaaaaatccaaaataggattatccatcatccttagagcaactccaaccattgacaccaaaacaccaaattttaacaccaaatttagtgttttggtattcatattttttttctatctccaaccataaacaccaaatcccacaccaaaaacaaaatttttattattatattattaaatataaatatttaatttaataatagttattttaataatttgataaaaactaattcaatttagaactgcttaattttaatttaattaatataagattacaatcgataaatattaaataataaaaaatacattacattgtactaaatttcagaattaatatattcggaccacaagtgctcaattaatgtgatatttatttcaaaaatttgtgcactttatcattttctattaatttaattaaaatttgatattacaaaaacaaaagcattcaaaaaaatattgatagtatacttgtcttttatttgaaaatcaacaatttaaatataaaactaaatcaaaaacataaatagaataatatatattttttagtgttttgtgaacaatgttacatcaaatatggcatccattatgatgttaggttggagaagaattatcaccaaatttagtgatttggcgtctccttggagatgatcttagtccttacttacacatcattaaaatccacaaccccatcattgcccatcactaatcaataaagggcattactaaacccaaaaacagattatcgaaacatacgtgggtccccacttcccccaagtcattttccattttcataaagtatgtttctttcccattatcacacatagccttacgtgtttcacttaaccaccatcgattcagatcttaaataatcaaacagtaagcataagagcagcgtaggtacactcgcgtcgcagaagatcaaaagtcaacgataggtcagagtaaggaaacctcgccatgaagtgaaagttaataaacaccgtagctcccgaggtacaagaaacagaaaaacaaatatatttatgtctgaaaacttgaataaaataataatatttatatatttaaatatgttgggaatattattaatttattaacaagaacacagtaacgcaatcacagactccacagtccaaggagttttgcatactcaccaagccacaatcatttctctcttctctatctctctggttttgaatcggcgacgactgagtcaactcggtgttgttactggtttcgtcgtatgtgttgtaactgattaagttg

SEQ ID NO: 106 - DNA, 3000 bp, Arabidopsis thaliana
aaggtgtgggctggagaattcaattattataaggtttaatttcttaggtctttggaaattgcaagtcccaaggccaactaataatgacctcgatctttgcgttaaccggaccgtccatctactcttcctttattttattttaatcatttttccactagttaatacgtttacacttgttcatgacccgtattaaagaaaagaatttgtgttaggagaaaactaaacaattagcgtcaataatcatttacctagttaataaaatacaccgagttgttaatttttattaactaaaatcaagtaactttgacatcgatcggtaatttatttcatatttcaattagtgataacaattataatcctaatgatattcttaggaaaactaacaatgaagttattagcattaactgggacaattcttgatcttacgtgtgctttgatctttgacttcaccacaagctagcatattagcagtagtatataatgcacggaatgaaatcgtcatcacttcattggtatcatacgaaggagtgttggaatatgcaaaaaaaagaaaaaaagaattggtaggctcaaattattaggtctcttattgtatttgtatcagtcgaagatttgtttttcttacaacgtaaatcgtagtggtttgtatttgtaagaagatataacttgtatttctcaaatttaagtatagtgcttgtaaattcctcatatattattgaacatttttctaaatgcaaaaccaaaatataaaataaaacaattgaaccttttttacattgtacaatcaacaacatgtactatgtcatacgtatgatgtgatgtcaaattatattcttcaacatggagttgtgaaagttccatcagataataatttgaccaaattaagtgattcatgtaaccattttgaacagatttcaaggttgtttaaatgattggagattggtcacatatcttacacattacaatttattatggtagagtttttagagattgaataatgtgtggatcaaaccataggaacttgtcgcataaattcgttgcatacttgttttgtccggtatactagacatttcatcaatttgctttagcgcatcttcgataaaacttagtatatgtattacggttataatattagcagagcaataaacttctgagtaacacttgatcgtcaaggtggagtttgttggctttgtgaattgtgatgaagtagaaaaagatttgaaccatagaaagataaacttatatgtggagaattccactgcgttatataatgtctataatagaaccatagaaggattaaactttttgaaaagcctaaaagtaagaaataattgtaatctttttcttgctaacaaaataattgtagtttaagacctctatcgaccacgaagatctcgtagattatttgactaaccaagatgtacgaataatttttatttgaataaagtttcccaactctcaagttgcccttaagctgacagaatgtaacaacttgaatatctaattaaaccactattccaagatacagtaaaagatctatctatgagttcaataatattattttctaatcttaatattattgtaattgctatgaatattttaataagtcttagcagtactgtttacaactagacttgagctgcaaaaaaatattcttgaacgaaagcaaccggtcaaaagacacaaaaataacttttttaaaaaaatataaaaaatctccaacaaaccgtgcatgaaaacaaaagtatttatttaagaattacctatgattcggtacaaaatccaaaacattgaacatgaaaccaataattgttatgattattctcaagcattatactaccatatagtaacacagggcaatggaaaagagtaaccctcttttttagtatatgaagaaaaaaaacatttgaatatatgggaacttgaacttattcaacattgaaactagctgataaaatcataaaagtatgcacatgagacatgatgactgactaaaaataagtgttgaccaacaaaaaaagagagtaaaaaagactgaaaaaagttcataaaaatagtctttatacagtatacagtttttcacaaataaatgccaaatagaattgaatgaatgattactaatgagatttaccagacaaacctaattcattaattatgaaaacaagaaaaagaaatcatgaaaatctgtttttcgaggattttaataacaaaaggataaaataaaataaaaaagagagaataagataaccccaaaatgaaagttgtcactgtcagctcggattgtttagaattggaataattacgtgtttaattaaaccatacacagatttaactaatcaaatcacttttaaccaatttttaaacctttagctcacaaaaaaaaaatgtctctgcaaattataatccttgaatactttggctatggcggtgtttatgtttaatgatcaaaaagctctgttttttatgcaagcgtgggtataaaatccagttccttttccgattttttgttcttccttcttcttcacttcctttttttcttctccatttctcaaaaaggccactcctttgcttatctttctctctctctgcagctgaagaacagagaaaaagggttttttattgtctgacccaaaggacccagtttcaattcagcttttgttgttagaaattgaggtaaaagattcaaaatttgttcagaaaagtggcacagattctgaaaaattaatatctttcttctcactcttttagctcgattctaagcttaaatctggtttagggtttttggagtttgtactgataaagcatgatcctttttgtcttccgttgactgattctgttccttttctcaatatattgatttgggcttctcttgttcttcatcgaatcattggtcttcaaggtgaatgtgtttgtgtagtggcaagtcttgttggtttgtagtggttttgatcttggagattttctgattagtgagtggtgttcatcaagtattagaagaag

SEQ ID NO: 107 - DNA, 3000 bp, Arabidopsis thaliana
attgtgaaatcctacaagaaactgcatctctgagacacgatggcacagtcaggttccgaacgttaagagtcgccggagttggagtgaaccaccacaacagtaatcgcctagagccgtctaaaaacaaaatcaaagagattatcttaacaacgacgtcgtttcttcgttccttttctacttctgaggcccaaatgatttttgttactattcactaatgggcttaattaaggcccaatattgatagatacgcggcgactagttaaggggcaacaaatatggcccacttaaaaagaaacacgacttttcttatcgcgttgttctaacgccaccgaccgaacacttctttttcttctgcaataaaccaaaaaaagttaaaaattcaaaaacttaattactaagcaaaagtgtgcacgaagaacaaagcgacgcatccgattttatttgtttgataagttcgtgtcgtcttcgtctctctaacccaattctgtggtgtctgaagaaagcagaatcaaatccatgtctttcagaggacttagcagggtaaaattacaaaaaaaaacttttctcttcttgcttaaaatcgatgtactcttgtctatgtcgcaagcatcttcaatgttaaaaatttgatttttatgaagtcgatgttaaaaaaaactaaacccatctccatttttactcttattgagggtttaagatcactagatgaagtcaattcgatgaattttggattaaaaatcgaatcttttggtatggttttgatatgtgttttggttttatatctgtagccaaatgcaatatctggaatgggtgttgcagatgagagcaaaaccacatttctagagcttcaaaggaaaaaaactcatcgctatgtggtcttcaagattgatgaatccaaaaaagaagttgttgttgagaaaactggaaatcctacagagagctacgatgatttcttagcttcacttcctgataatgactgcagatacgctgtttatgactttgatttcgttacttctgagaattgtcaaaagagcaaaatcttcttctttgcttggttagtttgatttttaccattagtaagtctataagggttttgatgtgttgagactaaaacattttgatttgggactactgatgttgtaggtctccttcgacctctggaattcgagccaaggtgctttactcgacttctaaagaccagttaagtagggagcttcaagggattcactatgagattcaagctactgatcctactgaggttgatcttgaagtgttacgcgaacgagcgaactgagagcaagcaagattgctatgtctattcaaaacttatggtaatgtaatgaataattcgtattctctgtggattgatttgtgtaaacacagtttcatgttctatgtcaaactgtataacctctggtgtttcagattgcacaacctaaagcttaggtaaactgaatatggtttaagatcgtaaaaggttgatatattagtaatgttaagagggagaagaaacttctctttagtagataacgagaatgttgatgagcatgatgagagagttcttaaactagtctagcaaattctgtataagctcttgttgtagccatcttgaattcgagtctaatccttgcgaacaatatagaaagtggtagtgtgtaaagtttccctcatcatttgtggtttctttttctcactttcttcggtgtagtaaaatttaagttgtatgtataatagttctatcatatacctgctttctaaaacaaaacaaaaaaaacctctttcttgtttccgcatatccccttccgattccattgagagcaaaaccattttatgaggttgtatacttaacctaccattcctaattcctaattgcttaactgttaccaaactgtgatgtcaaaaagaaaaatgttaccaaactggagtcaaaatgacataaatacccttgaccatttgagaaaaaatgtaaggaattaggaggttgcaagtggggtccattgccgttgtggccaaaagcgagattgcatgacccaactgaaatctcaattaggaaggagattgcattatttttatatgtttatttatcatatctcatattaaggtccatttccttcagtctattatcatcatgtatccactatttgtttgacattggggaacattttagaataagaagtggaactggaaagtaaaatatatctattagttccaacatatttcattagttttaatttttcttgctccaaactctagtagtttataaatacacggcttgaattacgtttaaaagaaaataactaaactttctaataattctccaaatattagaacatgtcttagtaaagaattaaagctttgtttgtgtcagaaattaaaggttggaaccattttgttctcattcataaaagggagaagaaaaaaaagaaaagaaaaattgtttcctctgtcttgaagtatttagtagagagctgtccaaaacaatacaaacacgtccaaaaaaccctctcctatgggaacaagaaagacccaaaagacacaaacacacacccaaactccatcaaacagaaataaagcaaaccaaaaaagcttctctcttttttcctacatttgatttaagctctaaatgttgaaatgatctttgatttgacattgtgaagctgaaatatagctggtggtaaccttcaaagacgacaaagaaggaaaaagatcatcatcttctaacttttggtaattagataatttcattctctaaacaaagtctgatttttgaatcaatactaaaaaagtgatagaagagaagctatcaaaacacaaaaacagaggatttttcttttccaatctaaaagaaaggtgcttaagggaattagtttgagattaggttttaactgagtttatacaaactttctttatttaatgaaattaacttagattggcttttgtcttaaagattaattatggttgtgaaaattagttttggttgcagaaaaaaatcagttgaaa

SEQ ID NO: 108 - DNA, 3000 bp, Arabidopsis thaliana
gccaaaaagtcatttattttattaatattaattttattaatgatatgactctgaattataatctaaatattttagctaataacataggagtgcaccatatttatttaatagggaaatgtaccatatgacccgaatgcatttttatccaaatccaccaaaaaagtcttgcaaaaatactataaagataagaagcgatagtcggttttgatagatataagattagcaaatatattagttagcttaaattagttaaagaatacaaattaaaagggtatgcaccatatttatttaatagggaaatgtaccatatgacccgaatgcatttttatccaaatccaccaaaaaagtcttgcaaaaatactatagagataagaaacgatagtcggttttaatagatataagattagcaaatatattagttagcttaaattagttaaagaatacaaattaaaaaggtatattacactttattcaaatattgtatcaaaacttatataacacagagatttgataatttttaattgttgaatacttcttttttgtgctaattttatgtgattaagatttaattgatttcatatataaaatattaaattgacttatttgtttataatttggtaacagatagatatttgaatattcagtatattttgcttcagtttaggaaatctttgatgacccgtctttagatccaataagtcctataatctagagattaatttgcagtataccgcaggtaggcttatattttagttaaactaaaaacttttattgtaaagatgatttaaaaatatatgatattattttatttgattttaaatgtatagtaaactgtgagttgtatatgttttgttgatattatctatattgtttagtgtttaagattatacacttgtagtttgattgttaatttaagagtttcacatgtagtataccatcttgtattaatatcgatctaaacccgtcaattctaggatttttcagcttatattaaaaattgaatcacatctaatatgttattaactattgtaatatataagattataaattttcaatataatatgtatgaaattgaatatgaatatttcaaatttatgtccccttactcagtagaaagttttcttaaatctatttttcacccgttataatattatttcatgtattgaacagtttatatttgtttttaaaaattcaaattatggcatatgcgaaaaaactctaattatttttttataatgatgatattatttttccgtataaatagaatcatataaagatgagaagtgaactataataattaataaaaaattaatatgataatttagataccaaatatagtttgttgattttaattggttacttttttagaaattaataatctatttcgtttttctaattaaattaaattaattaaatttagatatcaaatcttatatgttgattttgattggctattatttttggaaattaatattgtatttcgttttttaattaatttaattaattaaattagtatttgactttttaatccttaaagagataaattaatttactttttaaaattttatttctaatggcatacctatgtaattacttacaaaaattaaggttatatttaaaatgtacttcccaaataatatagtaggattgtcactacgactacgagggacacttgctaaattttcggaatattttatcttatgaattagaaggaaaattattatggaagttgtaataaaacatgtacaacattttaaatatcataggttttttattacaaaagtattatattttaatagtatatgggaaaaacaattgtctcttcaaaatttattcaaaataaaaaaaaaattaaactatagacgaatgagcctcgaaaacgcaattcctcaaacatttttttttacaatcttatccaccaacgtatgagtcaaatcaaacaaatagacaccttaaagtaaagtatatacatagttcactaatatttttgctagacggttaacctctttatacatatacgagattcgaattatctactctgtagataaaatatatgatacaaacttatcaagaaagacaattgggttcgactcacaaactcttgcctttaagaatcctaccactaattccgcagctctagcctcatcactctcttctcccatgggatatacaattcatagtagacttcctacaacttcggtaaacgagccgagtatacaatgtttagcgcacaatttccgcgggaaatacaaaaaagattgtgatgttaatgtgatgaatttgtaattaaacacacgataaattagtgcaatgtgtaaaatattttataaatttgtgagtaatgggtaaaaaaaaaagtaaagaaggaagcaaagttcagttggtgaatcattttgctggccattactctataagagagagagatcctatctccataaaatcccataccctcaaacacacacacactcaccatcccactaactcgaatagttaacatgcgcacaccgatccttggcctttcgttgctaaaatgagcatggtgcgtgattcacccgcttacttgctcgatttctccttcacccttttaaaaaggaacgtcttttagcttacctctgcctcctttaccctctctctctctctatctctatctctgttctttcctttttccggcgaatttctgggctgagattgttagtgtctctgagtgatgcagagatcaactgttgtagttaatcaatatcttctgacataagctaaactcgattctttcttacaatctctctgtctctctctgcttccttttctactgtcttctttcttcttctctagcttttgaattttcaatattgatttctcccatggcgagtagcagttgcagcagatctatctctgtttcaaattctgattctctcggtgttttttgtttgagctagggctaaattagtttccttcttgggtttttattcgtaatccgattcaaagtttgtatctttgggaggg

SEQ ID NO: 109 - DNA, 3000 bp, Arabidopsis thaliana
acctaaatgatctcataattagtcagtacccactccacttaacatttttctcacgagaaagtaaaatagatggaatgattagtaaaatagtccaagaaaaaaagtttggtcgactcgacaaagttatttgatctcgtgactaatatacattttctgaaaacttttaataattaacttagcaaatacaatgttgtttttcgagtttatttgccatgacaatttctcaccgccttaacaaattcatttttaaaaagttctagaatcattttggctattggttatttatatatcaaacaaaatataaaggacagaaatccttagaagatgtataaaacgacggcaaggagaaataaactatcaaagaaggtacaggcgataacttagccaggatttagctcctgtgccaaatgggaaagtgacccatttgatctatataacattcaaagtcctgattttgactgttgaatattatcataaaaactcattataaaaaaaccaaagtaataaaagttgccacaacaatatcagtacgcatccaatcttctcgggaagagaaacaaaatcaaattaagaaaggttttcaaagaaggaagagagtcaaaggaacataatatccaaattttcaacttcataaactttttctaaatttattcaacatgaaaaaggagggaaacattgaatggtatcaatcagtatcaggtttctaaaaagggaatgttcatacttacaacaaagaaaatttaaacaacaatcaaaattagaaagacagcaagaaaagtagaaaactttggcattttgatttacatttatgaatttccacatttatcatgaggtcggtggaagcggcggagcaacagttattttaaccgccgcaacaagtcttcaattctccttcctctccgccgccaatctgccgacaagtttcttttcgtcttaagaaaatatattgggtctcgtttcgtacaacaaagtgtagtgtttgggctttactcagaagcccataagtattttattattatttttagacagtaaggcccaatagtattttattgttactgtctgcgctgaaacaatttatgtttttcagcaaagtaatatcttactaatcagtaattacatacaccgtaacaccatcacgaattttcagtacacgacagagtataggtatgattgactgacaacaatataaaaaggctaaattagttagactgtcttattaattaaaaagtaatattgtactattactatactacttcacttaaatatttattcgacacacaaaaataaaccattcgtgtgaatgtttcccaaacacatttggggccgaagcattcgagcgggcgtaccactccaattacctggtacacataattgaagactatagtatgaaaattaatgttttatgtttttgtcacctaaatttttaataaaatgcagttgcagtttggttgtcattgttctgttgatccgttcattccgcgtcctgtatttggctatcacaatttcaatctatgaaaatttgaaatccgtatggtcaaaattatattttaaaaccacattgctagagaataattaaaaaaataataatcttcatgtggaatttatagaaattaatgatatacatttcaggaaaacttagcatgaagtatattattttaatgtgatgattttagaaatacaaaccgagacgcggtatgggatatggtccattacaagtaggcacaatggtccactaataattgttattacgacaacagaattaattgcctatttaaaacgaaatgaatcatcgaagaacatactagatctttttccaatttacaaccaaaaaaaacattattaggtgagtagtaaaaagattaaggttatcagaaactaactgtagtagtatgttgtgtgaaattcttttgtatttcttattaagccaagggtgccctttcaatgcaacgtgataaacgccaaaaacgatgatatgaacaattataaactcgttgagagcattgaactcggataataaatcatcttttatatacatcgtagataacaaacaaacacgtaattaaatttgacgtatagcaaaagacttgaagaataaaacgtcaagttaaagataattttggtatatatgagaaaggtatcgacaaaaaccataacgctatagatgattgtgatttgacaaaaacaccctcaaatcattgttttcagagtttttttagataaggtacagataagaaaccacctctaaaaatcaagcaatagatctcatcgcttaaaagaagagagagatcttcacttgtatgtgtcccactgattccaacacaatgtcccagaacttgccacgtgtcgttcatttcaaaagattgcagtactgttgtccctagagaatcattatctccctcgctgtaatatctttatgctcctgtcactttctgtctgtacccaaaagaagtaatgaacctctctcatcttcttcttctctgtttctttcatgttttgtgagttgtttctcaacaattttctggtctcttagagtgagaggagagagatagagagttgtgttgggcgtggaacttggactagttccacatatcaggttatatagatcttctctttcaacttctgattcgtccagaagctttcctaatctggtcagtagtactctttttatacgggtttttggttttataagatgtggctatatttggaaataactattttgcaagctttcctagattgccagaatataaaaaaagatgtttaacaagagaacggactcatggacttgctttaaattttaattattttaaaatcattctataatgattagagtaaataaactattaggactctgaattataaaattcgattttatatatgctcctccttgtatctcttaatcataagttatcattagctctgttcactagtgctataaaatatattctgaggttaataaaacttttttttctttttattttgaaatgtctccagagatctgac

SEQ ID NO: 110 - DNA, 3000 bp, Arabidopsis thaliana
tgtgagattatgataaacaaagaaagccacgtggcgcatgatgtatttttgccgtacttttgaatataaaggttaaaaatgtcgacctcatgtggcccattgaagcccacgaaaaacgcgtgatatataaagaagaatagaagatgagttgcgtaaacaaagcgacttatttagcccctttgttcctaaccgaattttcccaagtaacaccactttgcaacattagttttacacatattggtagctttcgaagaaaacatacgttgaatgacaaaatatatagtacatattaacatatatatactcccacggttcctttatacaaatatgttttagaaaaacaaacttgttttaagattttatgcatgtttttctatgtagtttttaaagtatagttttcgagaaaatatagaggtatataaatgaacggtaacactttttttaataagaaatagtgatacaatataaattttagtacctatattatgaattcacaatagagtcggttttgttaactcgtttttatttttggcttattttccctacattttgttgataatcattcaagttatatatcctttacacttctcaacttataaatggatagacgcgtttataattgagaaaaagaatgcgaaattgataagctgctcaaatcttctacaacttttcatctacgaaatggttagacgcgtttttcgttagaatagagaaagagaatgcgaaattgcgaggacaaaagaagtgaaacacgacaaatcatttttgcaatttacgttttcaaaaggcatatgagacaggagaagttattgtctgcaataaagaccaccgtagtcacgagtgtctccacttgaccccacattttccctatcattcgctctctgccattcgattattgagccctactcttatccgttattgtttttttattctcgttgcataatctcactaatgtatatataacactcgtttgaattttgttaaaactattttgttttattttatataaaattaccgaaattcaatctacaaattcaaatttaaattaggttctctacatatcttaaaaagataaataagtgaaattcataatgataaagccaattttgttttgtaactattattagcttcttttttcttttttttgaagcaatgtatctaatctattctcttctaacgaaagagtattaattattatagacaaaaaaaaatagtattaaacaagcctacgcaaaacacgttcagtattaggttatagtttttagtactaattaaaatatgagatatgagtttttttgttctattagaacttaagaagataaagaatttataagttggtgcgactccgaattactcaaaagacaccaatcatcgcgttatcatcctaatctacaaaacaagaggtcaaattttgcatgtcacgtcacaatattgtacattatcatcacgtttttttacaaagctttagtatatcaacgtatacatttcaatgtacgagttttcattgtactatctatccctaagtttgaattaggtttatcgaatctctttctttatttatatgcaaattttaatgatgtcattttaaattattataagaaaatatccccatacaaaacatggtgaggcttatctcatgcgataatactttaaaataggttatgaatataatcatgtaattataaaaaaagtttttaattaatggggagaaaacaattagaaaactacaaacacatgatgatagaaaagtaggttaaaagtccatcacatggtgctctctcacagaacgagaccctttttgttgaacgttactgttgggcatgagattcacgcaaatcctatgcgacaaataattttctttccataaaaatctaaataaagaaagaacgtaccattttttatatcgaagttaaggactatatatatactattgataagaataatatactcagactatactattaattaaatggacccacgttaataacgatgtctgaaataaccaaaaccccaccagacaattcagacaatatttctttgtttctttatgcatgtgagttatttttattggtagagaaaaaaataaaaacaaataattaatttagtactatttagtacataataaattttaaaatatttcgaccatgtgatctatacttcttaagtacattactataatttgaatctctcacgtaggtacatacacacgtgtgtacacaaaacactattttctctaaaatttaccaagtgcaaatatcgttgtttcactaaaatcaccatcaagtatgtattacttttacgaaattaatcggatttggagacaaattcaaagactagccagatttaggggtgagataatccatttgcaaaatagatttgaaaagagattttagattttctatctttattcggagagaaacaatcaaagtaagtgaacttaaaatcaggaaacagagttaataatcagagtaattattaaccatggttaagttgaataaccaaagtaattaacgtgcataagtaaccatggttgggtttttaaaaagagctttcatacaaacttcaattaccccagcaagtcttgtctccttctctctctctctccctctctaactgtatcttcttcttcttcttcaaccttcagacttttctagttgcaactctcattcaattgttcaatttctctgtaaaaatcaaagctttttggaatctttcttcggcgagatatttcttcaccggcgcaagcttctcttgagcgtgattcatcactgggtttgcattttttcctggtgggtattcttcaaattgttcaaagctccgaccttttcttccttagaatctgattactggaatcttgaagctggagagactcgagtttatatggtttcaagcatcgttgagtcaatcattgagttgtgtagaagaaaggtttggttttcttctccgtttaagtggttttgggtttggtaggatttggtgtaatctgggagataaagaaag

SEQ ID NO: 111 - DNA, 3000 bp, Arabidopsis thaliana
accataacagaatcttaaaaccaagtcgaacccatctgacccacctggaaaatcttcaacctcgatgatgattctactgttcttgtgattctttttcttcttattgctctgttttatcatcttcctcaagaagcctgagtactctgagatcaaatcctaacccaagaaacagagaaacagagtttaattcagaaaatggaaacagaggaagttagggtttgaattagtgtggagatttgatttggtttattacctgattgacgaagaaagtaaattggttattgagattgatttgaagatcacagcaaagagacattgtatcaacttcttttgcatttggtgaagatgaaacttcttgtgagctttcttgttcttgttcttccttttggattggagagagagagagagagcaataatagttatcacatggaaacggctatttatatatctctttttcggcgtctttatttcaattatctaatgtacactttcttttatcatcctttataactcatataaatttatgcaaaaggaacttatatacaaacgtcatcgaaaaattgtataaactggtcgcatggaccaacttgtaaccctagtgtgtagaccatctaaaatagtgaaaatgtaataatttgttgccgtttgtaatgaaaaaattattgttcgttattgtttagtttttttggtattagataataagattcattgcttaatcgaaatgtactatatgatattaattttggagcaattagcttgacatgcatagtttacttctttacattagaaaaccttttttctaacatcgaacttaagaaaagttatataaactgcattaattgactgcatgtttattttgaaatccatataatcttgtgtgcagagcacaaatcaatatgacgaggcgttgttagttgttactaaaaataaccaggtgcaaagattgattccttaatgcttcattgatcaggatggccaaaaaataaaataaaaattggtgttagaggaagaaaaaaaaaatacagtaggtgggtaaacaaacagcagggaaatagcttacaatttgttgagaataattcataattatgaccaacattattcaggttatttggggtaaagtaaaaatgtattgcatcaaatcaaataagatttacattttagacagtgaactataggtcacgactaatatcaaatatatatttccagtagcacagaaaatgatgcttcatgaactctcacttatgacttgtcaatagctcaaggactatgctactcaagttgtaatatatatattctgtatttatatgctgttttatacacacgtaacgtatatatgaatgtgccccctttgtttttatgtgaattataaatattctccctttcttggcattacattataaattcgtaatactattattccacttccatgtaatttcaagagttttcttccctttttatttgtagaatatttatatatcagttgcttgtaaagttgggagtttcactttcattgcatgtgaatgggccgggtagggttttatgactctaacgtttgtgaataaagtcgactacttgcttttcatcattatccaaatccagccatgtaaaatatatgtaattgaaaacgatatatgtaacaaaaatgttataaaaaaaagatacaccaatgtcgatatacattacgactctttgagtacaaaataaaaaaatatgactaacttccgataatagtttttatttattattaaaaatgaagtttccaaataaaatatcattttaatatccatacaaattatgaatagtatgtgaggtttagggcaaagtcttctgagggttcatcaatgggatgggagtgggacgaagaaacgaaggcgacgagaggatttaggttttattgttttaaaatttttgtgctctagtatttaagccctttaacaggattttacagggaccaacaaaaatgtaaagccccaaaggaagaagcccacttaaaaaatactaaagtaaaaataaataattaacaggcccatttggcctcatcgactaaagctagcccaaaaagaggatacaataaaattacataaattttgtgtccttttcgatttaactttttcttttagaagaacaatcctttgtttttttgtgcaaatctttagaatctcgagaccaaaacttaagtaatcatcaaaaattttgtcaagtttacatttctatgccaaaaattatacaatatcataatgttcaagcagtgctctagagagcaagaaaaaaatggttaagacataaaaactagtcggctaacactgttcaagaaccatgatttatttgcttcatcaacgaactgattataattcaaatattacaacagagcggcaaatcattcgaaacgcggtacgaacattaaaatttgatgtgcattttggccaaaatatttgttgatggattcaattgggtagtggaagaagaaactgtcaaagtacacctactttgcagtcaagttgtaagaacataaagtacgtatttttttacaatttctaaatatactaaaagcttgcagaaagtatgtatatctagaagtacgtatctcttacgtttgtgaaaactatttttataatttgacaattttaaatgatttgattattacacaaaaatagtcgaggttatgtaaaaatattttttaaaattttcgatattttgtccggtacaattatgtcaccatctcgattcaagatataaaagagttaatttagtttcacaataaaaatctcgtacttacttttcaaactttataattgtgttggataaaaagtacaattgaatcttttaaaatcaacaatgagtgtctgttttgataaatgcataaattggagtgaaaagaaaaaaacaattccagcttttgcgaagttggacatattaaattctacacaattgtttttttttaaaaatacagaattgtagatagaatgaatattgttttttttaattaaaataattgaaaaa

SEQ ID NO: 112 - DNA, 3000 bp, Arabidopsis thaliana
gtgtagtggccacatcgatcagtccatatgtattcttttgtttttgtgatagaaaaagaaattttatgtataataatccatgagttttgggtcatgtggtcatgtcatctcctaccttttgcttgaatatgctttggagggatcggattcctacttttgttcctacgtattttaagattatgaaaatgacgatcatttctcacaatcacattaaaaataacacaccttatcatcaacttatatgttattcatgtaacagaacactgagtgtaattaaaaacagaacacattgcatatttgcttcatttgttgctcatgaatgatgtgaaatgattctatataacttgcttttgaaaagaaactggattaaatcaaggtggtattggataaacggagcatcttaggagagatattgagttattaaacgaacatattttgctacaaccatatacttaagtaacatctagttatgtcattatgcggatatcacacttttacttggtttaagaatgttatatgaattgaatattcttcagaaaaatatgtcaaaggttttgggaagtgcgaccaaaaaaaatgttttgggaaatgtatttctctctctttttacaccggagaaaatggacgacacggacaaaaaaaagaaaccaaaagaaaatgctttagtaacacaaattacaaatttgaaatgtaaagatgatattgctaaatttaacgggcattgtggcccaaatctcttcgttttcgatccaaacactcgtccatagctcttttcccccccaacaaacatatgacccattttgaaagacacttaaaagagcacctagaaatctataaaatcgactaaaagacatgcaataagaaaataaataaatggtcaataagaaaataaattttaaaaactgaaaattacagtttagattttggattacgtcaatgatgaaagttatactgacatgttttacccactgaaacatggcattaaattcttgcaactgcaaaacatacatgatttaggccaactccaataggactctaaaacaccattttagtgtaatttttgcactaaaagctttccaatggaactctaaaatgcacaccattttagtgtaatgctacagtgttacatcaaatttggtctgatactattcacaactctaaacactattcacttattatatcaataaaaattcaattaacaaatataaaattacaaatgattaatagatataaaatataaaaatgaatggatacattaatatattatatctcttgaaatagtttatttagttatgatatttttatattattatgtatgaaaatactcaaaatagttacaattttatgtatttttaaatatatatttcaatgtactatgtttataatgttatgtaattctatactaataataaatactaatcaaaactattaaataataaaagaaatcttttaaatagataatataatagtatttttttttttagtgtgatttttggtgttatgattggagagaacacaagttttaatgctaaaaatggtgtaatttgaacaccaaaatggtgttgagccttggagatgcccttagtaactagtcactatcgccaaaaactacaaaaccaacaatagcttttttcctaatcatatgtgttcaggtttacatacttttaaaatactgcatttagagcattaacaaaaaaaaatgaatttagataacacaaatgtcgtgcaataataataataatgcataagtttaaactattgtcatcaataatctcgaccccagatgatattgctttaattagtgggcttcttggcccaaatagtaacaatcattttctttccgttcgacttcaaaaaatatcatttttgccgtcatggaagttttttttgttgttgttaaaacccgtcatggaagttttatacataaatgagtcaaactttgaccttgtgaatttatttaccacttaccatctcaaagtttacaagatttgttacagtggttaaaaacacaccatccattttacaacagttaggtaactttctcttttatttaccaagttccccttcccaagaaaacacgttcttatctgtgccaatcgctttctccaatttcttatgtatattatataatctgtatatgtcttttctttttttaacaaagtcagtaatatagcattttttattttggttggaaaaaggcttaatagattatgttttgtttgtttttttctcttgtagatgaaaacgttgaattattgttagtgtctttcttctttctttttctggataaaaatcctaataaaaaagataaaatcatgaaattaatacttaatgtctttgacactttgttctcaaattcaaattatcaaagcaaattaagcactctaattttgtggaaagtaatttacattttgagcaatttctattcttttgattacaatcacgaatagaaagtaactaaaaaaaatacatttcaaatctctttaacagaaacttttgcagtcacggttggagaaaagtaacgtggctatcgcccccgaaaaaaaaaacttttcagtaacatcattacgatggcacaatccgtaaatcagaatttgtttcgcaacctgacaaacatccctgtccatgggatcagtatcatctgatcgtaaacataatccaacgttccatattcaatcagtacaataccccgaaacaatccaacggcccagattccataagtacaataccctgaaaccgcctgacgagggtcgcgcgacaaacagtcgacaaaaaacatataacggaatcgtcttcgttcctcgtgtcgccgcctcctcttcaacacccaatcaccacaatccacgtgtatatctctcttttcttaattatttctttcttctatctccacccaataatcacaagccacgtggatatctctctgttttattctcttcttcacacagtcacgcatcattctcattttctcctctctctgttttttccctttcgccggagaaa

SEQ ID NO: 113 - DNA, 3000 bp, Arabidopsis thaliana
accattctttgtcccctttgttttttttttttgtatcttgtactcgtcttttgtttctagataaccaatatgttattacatgtatttggtcaagtattttctttgaataacgtataaaattctggaaagcgaacatagatagtaaaaacaagaaaaaaatagagtcaattctaagtaaattaaatcctatttgtgaaagtataaaaacaatactaaaagaaaattggagaattgagatttcaccatatgtacatagaaatgaaattcaaaagaaaaacagtgattctcagattttcaaggcactcatagttttttagtttcaagatttaatgataatgtctcgtccttttacaaatcattaagttgtaagagagttttgcttctttttgaaagaaaaaaaatactactcataatttactttatgtttatcataaattatgataactcgactttactgcaatgtgtttgcttgtcagtaaaaacatgggctggcttcaaatccggatgattgcatgtctcgtgactcttttgtagcctctcttgttggccaactcattccattttctcgttttaggctctttcttttttttagtcacaaagttgaccataccaacatgcaagaccaattattatatctctttttgacataaaccaattattatatcttcaaaattagaggtttttgaccaccactctgatatatttttggcttcgaaaccaaccaacaaaaaacatagcggtttaaaaattaaaaaaccgtctttatcataaaccaaaccataaaatgcagtgattcaccttctaatcttctgtttgacgtacaagtgataaatgacttcaaagctactcccgtttctttacgagtgatttcatttcatcataaagaaatatgtgttgctcttgttcttagaaaattatttctcccagtcctttacaataatgtagatttcttctgttagtatgataaatatatatatgattgaatgtatatatttaacatgttttacgaaaaaagtcagtgtatactatttatgggaaaagtatcactaacttcgaaatatagttgatatttgttagttttatgtctactttaatttaagtcatttaatcaaaaattataatgttgaggtccataaactttaaaagtcccaataatgtgtaattaagttttagaaagaatacttattggattttcatctatgactctatttagaaaagttgtgtctacagtgactagctgcaaaaaaaaggttatgtatagtatcgattgccccttaaaacggagtgaaaacatgttttcttgaatcaaatccaaagtttacaaaatagaggaagatttagatatggtctctaaagtctaaagtagtctaggactaggagggcaatcttgtgaggtattagtgatgttcttttcatgtatttaatatataaatgtaagtttgctgaagcttaatacattaatgaatatgaatgcatgaaaactcgataaagcaagatacgtgcgtgttactactatttgaggtttcgttcgtgccttttagaatagacctattgatactatattttatttcaataatttgggttagattacgcgctaaccccgtgattgatttgttttttttttgtctttaataataataattaccgaatcttaaaacatgataatgatacgtgtgggtgtgtgacattatgttctcttttaagattctatatgacgtcatttcccttccaaatgacatttgatttgcccttgtgccgatgcatagttttaggctctatctctttccttttttcgtgatgacaaggttaaagccttataacctcttggcccaataaatttgtatttgtatatgtaatatgttagatcaaaatgttttactgtgcaatgttattttacttggtttaatatttcaaacgacaatgttaccctgaaatagtataatagctagagatccctacttgtaaatatcaaaacattgaaaactatttttctgaatcatttggtgtaaccggctaagttatattattggtcggacaccaaatattatagaatagaaaaataaaataaaataaaaggatgcatgagtgagtcatttgttatggaagagtagtgaggacaagtgtctaatacactgcatacgggtacccccaaaaaaaaaaacacaaaggtacattgaatcacgtggctttcacgtgaacttcacgctctgctttttttacttcttccattgtttggtctactttttcctttcaagagaatgctgccaaacaccttgtaggtcctatcaatattttttgtgggcccagcccattccttattgttcttgtactgtgaatgttcttcccacaaccacgtgggctttttggcccgttctctctctctctcctccccaacacttttttttttgtcgtactatcggtttgtgaaacagagatttgttgtttcactgatgtttacaaaagatatttgtctatgttgtggcaatctgatattctgacggatgtctattattatatttttaagtcctttctatttgtattttatgtgatttcgtttttggaaacgacatcccttgcatttaaataatctttttataatttataaaggcacaataaagtatcaaaaaaaaaatctcaaagatgctaagattcgacttatataaacagtggtactgtacaacaggaaattcattgcacctgaaaaaataattaaaaacaggtgaaagagataataataccaaaaaaatgaaaaggaaagaaaagcgaaatataaaataagagcaaaagagtctgaagttgatcaacaaaagaaagattagctttcacttacttccactgaagaaataacttttggaacattcaacaagacaacaaaatatgacttccccatcatccaccttcagaccaaattaagttcttcaatcttgtttccctgtttcacacacatatatatatatatatatatatatatatatatatgtgtgtgtttgtgtgcagacg

SEQ ID NO: 114 - DNA, 3000 bp, Arabidopsis thaliana
cacttttatatttgtcttttgttgggtactgttgaacgaatgtttctttacttccatcacaagacaaataaataactcaatacgtcgcaagtgattctttatattcctaactgtcgactagaaagaaaataaatatcatagttctttgacaaaaaaaaaagaaaatatcatagttactttactccaaaattatagcctatgactagacttgattggccatagaaaatacttacatattatgttatgatggaatttcttcagtagctattcaattcttgttaggatacgacgctatattatgatggagtttcttcattatttacatgttatattatgatagatagaacaagaaacaaaaataaaaagcttctatgtaattaattatggaaactttctttggtaatttttgtttggacgttgtaaattactttgctgttttttattttatttttttttgtatatgttgcgttttcgtttattgttgatttatatattcatctaaacgtgcttccagttttaaataaatttattttgtatttgtaaacttaaaaggccacatggaaaattttcaaaactttacataaatgactgaaattacaatttacaccatttttcttcacacacttaagaagagtcaagactaaattttggaacattcaaacgggctaaaccattaagcatctttgtctgggccgaactcaaaatatatctctgttcaatccgtgccttcagcccaacatgtgttttttcagcccaataagtttcttgcatgttttgaaataaataatgaattttagtcgaattactttctctcatatcggcatattttgttcattttgtttgatgaatgggtttaagtcgtcgaagttggttaaccgatatcgtaacgtaagattgaaccggagtttcaatactcgttacattttttcgtattctagctaacgtgaacggatgttgtttatacagctttctactacaaaagtagatttcaaaattgaactgcgattttcttcttactcttctagaaacacttcctcatatttaataagaaacgaaagaattagactccgacaatattgggaatgtttagttgtcatttggacccaatataatcaattccatacatttgcaattgcaaggtgggtgagtcatcaaaatttatgaatcttccaaagattatagatagaacagcttttaattagcctaataaacaaaaggaaatacgattatgcatacaaaataaattaaatattaagacttttaatgaattcttaaccaaaaccatatcaagtcatatcatacactatcctccatacacgtggtagcatacataagtacgttaaataattttatttagcaaataattttattataatcatctttgatcaccaagatcatgttgggccatccaagccacgactttagtaatgtgaaaacaatatcataaggaacgaaacactgttcatttcatacaattaaaatacaactttttcctacacattttctcaagagtttagtaagtgagagacgaatgatttgagaaaacagtttttacttttttcgatttgtttctcaaactcagtattttcggatttctaatccagattaaaagttctgaataaaatcacggggtatggagcaaagccgatataagtaaaaacctttccatattgatagacactagatttttttttagttcataagatagatactagatttagtttgagtataatggattaatgtggaactagttgtattgtttagtatgtgtatgttgtatgatttagtgaccgtcttcagttttcttgatgtctttccacgttttacaaattcttgaaagaactgagaactcaaatgtatgatacataaccattgaaaaaaatatttccaccatcataaatagagttttacgaatcgtttcacaacttttaattcagttgacaccattaaataatcaatatttctttagttacaattcagtagaataaaattgcatatgctatattatctaattctatgaatattttctgtctatgatatttgatttttatatactttagattttggatcacccccacattatttcgcttttcagtcacattttgtgtttaatattgctagataagtccgtggttatagcttactttgttaaaatcatatatctcaacttatttcataacagtatctaaagaagatggaattttataaatatatagacactcaaaaatcagaagaaaatatatatccacaaataatagaagaaaacatagatttactgcattcaaatcaagggacatgaaagaatatcctggacccaagtgggttatattttcaataaaatttagcaaaaaaagttgacaatcaactaatcatcaccattattggccataatcattacgtacgcatacacatagccacgatgtctacctatgtttaaatctttgaattctgaaactacgtatcttttatttttgtttaaaaaaaacctagtacgtatcttctttccttacttagacatcatcttctaactttaaggatcgaaattagaagaaaaacaaatgattaatatctacaagaacagaattttgcatttatactcagatactcttctagtacctcacaaaaataaaatgaaattggaattgaacacgccctaaattcaagtactatacggtctatacccatttgagtatatgaataatgcatattgtgagtgaaagagatagatacgatacactcttttctttgtttttcaattggacaaaaggaaacagattttgatctctgaattgaacggtcaagatcgtatataattatttcaggagattaagatcccacgtgcttaaaaactctctgtcagactctttatgtataaaatcctcggcccactcttgttttgatagtacactcaatagaaagacacaaagaaagaaagaaaggacaaacagaaataacaaaaccttccatttcaagaaagcatcatctttgtgtgtccgaaaa

SEQ ID NO: 115 - DNA, 3000 bp, Arabidopsis thaliana
gtggtttagggttaaagaatctacgcgtttctaatttcaaagttacttttcttctttgatttctgatattgttaataatcaggtagagttttacgcaaggaaagttttttttctttctgttttctttatcaggcaatgattggcatttgtttgattgttctttgtttgttacacttaggtgagacttgaccatttattctttccctcttcttagggatcaaattgatgtcaacaagatttcaatctgaaacagggttttgaagtcttcttttggttcatttttgttcaaaactgaggattaggatgaagagtgctatcaaatccatagcaaatctacagcaaatccatcaattatagggccaattgctatatatttatcaaccaacacataatggcagagaagataataataaaaattgttcaagtctcactaaagtgtttcttacatgacataatgcaaaagcttataataaggtttctctatttttctgtatctactgtttgatctctttggtttcaattttagggttttgacttcaaaaactaattattctctcacgttacccaacgatacggatccaggaaactatttagaattagatcttgagaaatggacaataagattttaaaattaacaacctaatcatcatgtatgtgtacttggagctttagaaaaggaataatataagggcccctaatattaattattatttatttttatttttgacgccaacttatcagatttttttttttatgcagaagtaaaaaaaatacactaaattttgtttgcaagagccaagatgcttatatttcatgggatgtactgtcttggtgatgtgatatagtaatatagtgatatagatccagaaaactgttaaatatttagatgctttgataccatatcaggaatcttcaatcttctgtaacaaactcttgagagagagagtgaaagagaaagaagaaaaagatagaaacaaaataatcgtctatttgtaaatgtgtacaatgtactgtatatatactctatcacattttatactatagagtaaaatatactcatgataatattatagttaatttagtatttagatcttgagaaatgaaatactatataaaaatataaaattcgagggatttagtattaaatttttatggagatttgtaaaacactgaatttggtttgcaggcgccaagatgcttctgtcatggggcgtagtaatggaggaaaagagggagagatctagttgtaagtgaactggcttttatttctattttagtacttagattataatatcccaagtatattttgtttacctagcttaccatttctatgaagttcaacaattccgacaaatacttgacttaaaatatcaactttacataaaagagtttcatgtttgattgattatttttacctaatcgattatatattaagagtagcacgtttgcacaagacacaagacacatgagttccaggaaagtaaaaattatcttagtgtcgatcacttgtagtataatgtttgaatattctgattgaataaaatataaacttttgtgattttgtttgttcataatcgaacgtctttgacagtcatggtgattcacacatttaatcaaactgtgtataaaagatgagagcttttagaagagaacgccaatggttaaattcaaatcatactttaatcttttttttattgttgaatttacaattttcttgaaaaaaagaaaattcgtggaaataattaatgtcgtaaccaataccatataatataccataaaatcgtagcgagatctttggttggtgtcacatttttagtttacaagagaaaagtataaaactaatgggaatatgtattagattatattcaattggacccacaatttgattatggaaagtttcctgtcatcttctgtctatttttgcttatcataagttcgcttatcataagaaatttatgaaaattaatcatgaatgctttccttttattggttcttcaacaacatacatattcagatagtgagtgaaggacactttagtataaattacttgactatatatataagtttattactcagtaataatagcagaatttgaatacaagctttctatatacaaatgtttttacaattggccaacaacattttgatgcgcgtcataaggtttaatatttttatatgatgttagaaaatatttttttgaacagttttgatttttaattggtttcatattcgcataccacacctgatacataaattcatgtcaaatttggatgcattttgaaaaatgtatttatggagaaactaatatttttttaaaaataaaaccaagggaaacaagatgagtaaacatatatcaaaacaaaataaaaattgaggcgattttttttgtttctaagaagaaaccctaaaaatacacttaataatataaactcaaaaacctgatatattcaatagacgaataccctttttgtctccggcccgcaacatttttatattcattcaaataggacctcaaaatactgtatacgtcaatgagtaactttgaacaacctgtgaaatttgacaaatataaaacaatctataatataattaattagttttgacacccaaatgctgtgagaaaaaaggaatatttttagtgtgaaagttgagtagtattgcctttcacacgtgcaaattacttcatatgtgtgtccatctctatatatacatgtacatatatgcatgtgcattccactgttttcacacacaaatctctcttctctctctctcttctcctagaagctggtgagttttatttctttgtgattcaaaaaacataaatctcaacccttactaaatgtttcttgatcttgggtttttactatacgtcaaatcttgtatttgaaacccaagatgatctgctaatttatcttttttcttggttaaatacagtttcttgtttataaatcatacactaatattctttttaccattttcagattttcagaggcaacagca

SEQ ID NO: 116 - DNA, 3000 bp, Arabidopsis thaliana
gaggatagagcatttaggcacaataagagataggttacatgaccaaaaagtgcttatcattctagatgatgttaatgatctcgatttgtatgctttggctgatcagacaacgtggtttggtcctggaagtaggattatcgtgacaacagaagacaacgagcttttgcagaaacatgatattaacaatgtctaccatgtggattttccatctagaaaagaagctcttgagatcttttgcagatgtgcttttagacaaagctctgcacctgatacgattctaaagcttgcagaacgagtaacagagctttgtggtaatcttccattgggtctctgtgtcataggttcatctttacacgggaaaactgaggatgagtgggaaattttaattcgcagactagaaattagtcttgatcgagataacgaggcacaacttagagttgggtatgatagcttacatgagaacgagcaagctttatttctcagcattgcagtcttcttcaactataaagaccgtcagcttgtgatggccatgctccttgacagtaacctagatgtcgagtatgggttaagaaccctcgccaataaatctctaatacatatatctaggaatgagaaaatagtgatgcataacttactacaacatgtgggtagacaagccattcaaagacaagaaccttggaaacgccacatcttaatagatgctgacgagatatgcaatgtccttgaaaatgatacagtaagtattccacgttctaaacttaatcatattgtgaagattcacagatcttacatattgtgctcacgatttcttacctttgtaatattttttcaggatgctagaattgtgtcagggatatcatttgatatatccagaatcggcgaagtttttttaagcgagagagcttttaaaagattgtgtaatctccaattcctcagggtgtttaagactggatatgatgaaaaaaacagagtgcgcataccggagaacatggagtttccacctcgtctaaggttactacagtgggaagcatatccgaggagaagtctttctcttaaacttaacctggaatatcttgtcgaacttgatatggaaggtagcctgctcgagaagctatgggatggaactcaggttagttatcataaattcatatctttaatgatgttatacatattttctctctattctgatgtttctactctaacatctggtttacattcagccccttgcaaatctcaagaagatgtctttgtcaagttcatggtatttaaagaaacttccggatctgtcaaatgctacaaatctcgaagaattggatctgagagcttgccagaatttagtagagcttccttcctccttttcttatctgcataagctaaagtatttgaatatgatgggatgcagaaggctaaaagaagttccacctcatatcaacttgaagtctcttgaattggtcaacatgtatggatgctcaagattaaaaagctttccagatatttctacaaacatcagttcactcgacatatcatacactgatgtggaagaactacctgaatcaatgacgatgtggtctcgcctacgtactctcgaaatatacaaaagtagaaacctcaagatagtaacacatgtgcccctaaacctaacatatctagacctcagcgagactagaattgagaagattccagatgacatcaaaaatgttcatgggctgcaaattttatttctaggtggctgcagaaaactcgcatcattgccagagcttcctggttcgctcttgtacttatcagcaaacgagtgtgaatcacttgagagcgtatcttgcccttttaatacttcatacatggaactcagcttcaccaactgcttcaaactaaaccaagaagcacgcagaggaattattcaacaatcattttctcatgggtgggcatccttacctggaagagagttgcccactgacttataccaccgatctaccggacattccatcaccgttcgtctcgagggcaagactcctttttctgcattctttggatttaaggttttcctcgtgatttcccctaaccatgatgctgaagaaactagcaattctcccttattttgtcctcgcattggcaaaatcggttgctccgatgacgaaacacctatttatattatccccaaacctcgagcagaacatctagttatgtttcactctgacttgcataacaaggaaaaatgtcatgaagtaggcaacgagatactgtttgaattcagcaacatatccgacacctatgagattattgagtgtggtgtcagattctatacagatgaacaggtgaaatcagtgaaaggagaaatgaatatgaaatagaccaagtttgtgaagatgaaaacgattggagctatgagtttggacccgtggaagcattggaatgctctaaaaataatggacataatgatagcctaatctgtacttcgaacgaagacaagatcgaagccaacaaatacacagattgttggagttggctcatcatctgttttgatgtctcccatattgtgagaagcatcggaagtttagtttggggaggaagatgagagaagcaagaaggagaatatcaaagtggagaagtcgaacgaatttgcaagtgaggaaagaatatctgtttatactttacaatgacttgtttggctgcttcactgagttggatatgatgagtagtagcatcatactgtttgaattcggatgcagcaaatattactgaaatgcagtgtacggatcgtgaaaactgacaaaattgatagtagcaacaacagtgaattaatttgggcctgaaactatccgttttaaatgggcttttgagcctttcacattatctatgtaattttcgattttatcttccttttcttttcaccttctcgacgaacacacctacacaaaaatcaatcacagtctctgtctcactcgccggagtttcggtcactgcgccatctccggggtcgagttcgtcgtacttcatcgaact

SEQ ID NO: 117 - DNA, 3000 bp, Arabidopsis thaliana
cattagatgaacacatagaatcaatcccacaatttctcagaatagtttcatgtctgtttaatgttccaggctatacggttcaagaactatagggagtggataatgtccaattatcaggtgaggagactttagctcgtcacttagattgttttcttgatgcaaatagttttgaaatgtttcctttttctgcagccacgtttcagggagttgtataaacttgatcccgaatcgttattgcttccgtgtttccgcaaggcggtcagagaaaacaccgaggaaagcttcagacgtataatgtttgaaccgtttcctggtgtttacgtctttaaaatgtttcagcctgacttctttcagaaattgcttgttgaggtaatagtaacaaacacatcatcttgccacttattctctgccctgctcttacctctttgtttgattaatcaggtagagaatatgagaaagtggcttcatgaggcaaaattgatgatcaggaaaccaaacaataagagtaaatatggtgttgtgcttgacgactttggcatggatatcatgcttaagccactcgtggaggattttatctttcctatttgcaaaggcaaggcgtatatattacttaaaaatgcattagaaagacttttaaaaagtaacattaaacttcactatgttgttttgcagtattcttccctcaagtgtgtggaacaatgtttgacactcaacatggattcgttattgaaaattgtgaagatagggatgctgaattaggtgagtcccttttgattttctgatattacttgagaaaaccagagtgaattctttaatctggtgcagtgatcttttaaatctgcaggctttcatgtggaaaattcagacattacattgaatgtttgtttgagtaaacaaagtgagggaggggaaatattattcacaggcacacgatgcaataaacatttgaaagcaggtccaaagccagaggtatgtgagtcctcttacgttcctatattcagtaaatggcaaaatggttagctaataaaggaaccaattatttctcactgaaacaggaaatttttgagtactgtcatgaaccgggtcaagctatacttcaccttggctgccacagccatggtgcaaaagccgccataacatcttgtagtcgggccaatatgattctttggtgcataaagtaagcaatcatgaagcttgcctcaggatttcagatcacaactaaaacaccttttcttctgcatttccatttgcagctctttgttcagagagatgcaaacttatgacaacgaattccgagactggtgcggtcaatgcgcccgtgaaaagaaagaaaagaaaagccagagtcttgcttccaaaagaaaggttaagaaaagaaaaaaggacatgattttgctcaagtttataagatgttttgtttgagcatggttatgaacctgtgggggtccttattgcaggagatgattaggataatagagtgaagccgaagcccgctgaaaaaaatgaagtctatgctttgaattttgactctttacttggaaaataacactgagtatatgtagaatcatttgatgtaaataggtctttgtgtcttcgaatttcttacattactactatgtacatgaaagttaccagttacatgtttaggatcggctatatgtttacagtttactcgccgtatcgaagcagtgttcagtgtcagctgaaaaagagtacatatagccggtccattcggttagactcatgaaaaccggtttagtaatcatatgtttacagtgtcagctttttttttgaaatgtatgatttggttaaccggttttaaaattgtgaaccaattcaattgtgcaattccgaacactagcgattcgaagtagagaaagtaacattgtaccaagctaaaccaacggcgatgaatgctagaaccgcgatgtgatgtgtgattaaagagaaggttaggaggaagtagaggatgataaattgattcggaaatgtgtgaggttttgtgtgacgcgtgtggtggcgtcggcgatggactagcggcgctggtgattggttgtgcggtttctttaacgccggagattacttgattcgccaccattgttgctctggattctagaaacttctgaaaatcctaaattcgttgggaaaagaggagaaagtcaaactgattcatgagaagttaagaaagcccaagcccattaaattgagtatcacttaattcgttatttatactaaaaaagatcgttttctagaatcgaagttggtagtgtaaaagaaaaagaagttgaagaagcaagaattttccatcgaagtggtcaattatccgagtgtagtaaagataaaatctcttatcagaaaataaaataatcgaagttggtcaatatttttagtcaagtcattcacacgaggaaatttcccacccaagagttaggatacgtggaaagaaaatctcaatgactaatgtgttacaataattagacgaagaataaactaatgccacacacacacacgcacaaattccacttgtgatgactgatgaacttaattattattattaaaccctaaggtttgataaaacggtatagggccggctcttttcttttctccacggtgttgtgttttttgaactcacaaaggagattttgtactttaacttcaaaaagaaaattggttaatttgaaaacaaacaaacaaatagttatagcttttacgcgtcacgtaatgtctaaattttgttgccaagacacgtcacttgactttctctagagttcacctttgatacatcatttgactgtctctggttttctcctatatacgtcacttcatctaaccaagaagctgagaaaactattcattgaccacgttctcaatatgtttcacgtgtgttaaatcaacaaaaccacacgtgattaaatcataataggtatatagacacaccacacaaaagacaacatcaaaaatcacacaaatcaagattgtcaaacacactaagagagaaag

SEQ ID NO: 118 - DNA, 3000 bp, Arabidopsis thaliana
gcatttgcagatccggtccgacttgtaaattcgaccattttacctaaccatcatcctcaacttgcaaatgataaatttgaaactgatattccttatctcgtgtttattttcaataatattctaatatctatgttttatttactctttatatgtatgaaaggatgttattaatctaaggatcaagttaatcaccatggtatcaaattttcatttcatgtaacaaaattggatttttcttttcaagtttacccaacaaacaaggctttgtcgtctccaaattttggactaatggtacatagtgaaagccttaagaatcaacccaaaggagggtcttaccttattttaggagctttgtccataccaggaggtacaaaaaaaaaagatcacaacaacagacaatagatgccaaactagtttacaagtgcaatttatgcaaatgatgagactaaatgctaatctttactttagccgagtgaataatttgaagtgaaatgaacctaccaaaaatttaacaacctctcatatcatgatcttgggagtggacactttagaatcttccttggctgtgtcacctggaagaaagaacataaaaccagttagtgaacacacagctaatctccgaaaggcggcttctaatcatgttcatatctatttcccttcatgttacactctaaatcatatcgattctaaccccatttctctttgaattcaatacgtgcgtcaggttttctttatcaaccccaccaatctagcctagtttgtacttgcacagatgtaaattgatgtatcaaacagtgatacctaaccacacattctcaaaccagtaagccctcttctgttgttaaatctagggaaagtatttgtttgttctacaagtgacatatagacaaacatgactactctagtttgtatagatatgtaataaacaaacatctaagagaacaattctatacagataattgctgatacaagcaaaagagagggctgagagtaatcaccagattgattggttgtggtggtaacttcaccatagatggccttaagcgtcgacaaaggaacaaccgcggcattacccgcagaggcagcttcagcaaagagctgctgtttccactcccacatggtgagtttcattgccttattagacttgaagagtgactccttctgctctgctaaggcctcaacatacttctgctgtttatcagatctcaatcccaaaaccacaaacgatactcctagacacgtgtttatcacagcattgttgttcattgcttccgagagaaacattgcaatcttgttcgccattcctgtgtagtcaaatccatcagtcaaaggaatacatattagcaactatcaaccaaaaccatgcactgtgagcacaacaaactcaggtaaagctgaatatgaacacagagattgttgtatctaagaacattcaaacattagttaaatgatgaaatcaccaaattttgttggaatcgataacaaatggtgtcattttggctacatactctatattatgtggagatggtgatgctgattttacaattagagatcaatcagatcgatcaataagctaaacaacgaatccaggaaacaaataatgaaattgaagcaagaaaaacaaggaatctgggaggctaaatcggaatgagtaacgaagtttaagaacgaagaaaggctcacccgaaatgaaagatgcgttgacggctacggcggcgaggtttgatacgacggcgacgagagagaaatcgcttccgttccaatactaaaggttgttttggggatatgactgtaattctaaaacaatgttaggggtatttaggtatttcaacacttttgccaagtaagtaaagtacgcaacagtgatcattaagatatttgttttaaaagtgttaaagacgatcattcatcatcaacactaacactttttcaaattgtcgtctaaagtctctaaaaccaccatcgaagtcttgacagagagaattcgaatcggacagagaatttcttccgtagtttttcttgtaagcgaaaaaggtaaataaaagctttttcttcttcctctgttacgagtttctctttttggtactttccttaaatgtcaaaaacccttttttaagaaccgagggtttcgaatttcaggttgattttgatgattaaagggaatatcgtaattgatttcatgtttttcaagtttgaaatctgtatcctaggttaaaacctcgttgacttgtgaaaagtctaggtctacggaacataaaatgtctctttcttgttgttggtgtttgagattttgatcggttcatcatgtagatgaacaatgaactatgtacttcttctgatatttggctttatttatgtgaattttttttgatttttcataattctgtttttgtaaatgctcaaaaaccttatccttataactattcttatttttgtttttactgataactactctgtgaagttctctgaaagttttcttctttttggttattactatgagaaaatcttgttttgcaacaccatttactgaaaatttgtgtctgaatatgttcatgttcgtgcacacggcatgattagccaaatgcacaagcttactcatttgcacatcttagagaaattcttccaatcttttctttttggaaactatttgctagcttttgttggtaacataagtgcctttaccttgtaatattaagcttagatagccgaatcgtgtttgcaaaactgtttattgtgcttgtattttaccttgtttatatatatagtttcataaacaggagatactagaatcttactctgcaaagctgttcatttttctgtgtctattcttcatgcctatagtttggtgcaaactgtttattagaggtctgtgtctgaacaatctctttgttatcaataagtttcagaagctgctcaaaccttgtttcttaccactgttttgttgacattttgtcttttctcttttagaagtttagttagctcgtgtgagagaagggtgta

SEQ ID NO: 119 - DNA, 3000 bp, Arabidopsis thaliana
tgatcacaaagcttgtcgggatgtccctcgttgacggattcagatgtgaacaaaaaagattccatttttccgatctgattcacgaaagaaacctaatacagagcagagaaatcaaacaagatcaatgagaagtagtataaacacacataacaaactcgaatcaattaaaaattggaatctagattcaataaccagatctataaatcaacacttctctcaaacaaaaatcgacacttggttcaaattctacagaaatgcaggaatcttgagaaagtatgaatcgaagaaaagtgaacataccttaaaaggagattagtaatgaaggttgagctaaagaaatgtggtggtagtagtagtacgaaggtgaaggaggagcgtataagctttatatatacgagctcgtcgagggggttggtgtaagatcgtaatttcgtccagattcattcccagtttcatctaactgtgttcagacaatgagatctagatatctgacggttcagattagatctagaaatgtaagaaggttttaaaccgttggatttgcttcactggaccaccgcgtgcgagtacaacttgacagcatctaatgaagaagattgcgaatcacgacgattataataatagttatcggtactcaaattaatgctgcaaattagatatttttgagcatgtaaagtgaatttaaagagttaatgataattaatgtcgtaaatcatgaagaagttgtgtgattagagaagggtttgtgtgattgtgtcggtgaacataattagagattatacacacacaggctgtctctttactcttttatagaagggtccacttgccaccggtaaaatgacaacatagaattcttcttttgtttgctttttagtagtgtcggctagcttaggttgtcaaatatgactgactattgttgggtggtctaaatctgatcttgtctgatccgaaaaaggtaaaactgcacagttacgccaatatgcgaagttcatgtccggtctgaaaaggctagatttagttattgggctcaaaatgggccaaggccttgcaaataacgaaatacaccaagcgataaaatttgaagcccatgactatgaggcagttgttatttgttaagttagagaagaaattggaacaaaatacactaaaaccttctataaattaataggtcaagggactggcacctcctagaggattccgatccgctcttatccaaagatcggagctttacaaagaagcaccgtgctcaagccaaagcagcaacgaaggagaaattacctgcaaaaatgatgacattgtccgatcttccaagtgatttggcagaggaggttctgtctaagattccggtgacatctctgagaggggtcagagctacttgcaaaaagtggaacactttatccaaagatcggagctttacaaggaaacaccttgctcaagccaaagcagcggcagcaagggagtttatggtggtcatggtgatggattttcaggtttatttgatgggcatcaatctccataaggacgttgacgcaactataaacggtcaaggtaaacttattagcttagacgattccaatcaagtcgatatatcttacgtctatcactgcgacagtttagtcttatgcatcccaaaagactgcgctaggcttgttgtttggaatccgtattggggccaaaccttatggttcaagcccactagtcttcgccattttccgcactggtatatgtatgctattggataccagatgcgaagaggaaaccgagacgcgaaaacttcaaggtggttgttgacttgtagaccgacgaccaaaactatcacaaagaacacgatcgatcacctttgaaagtcaaaagatagatactcgcttcacatctatattttacaactttattatattccacacaaatcatatactatacatacattagtctccttttattaaataccagccgtctattttggtttttcttattacatgcttaaaaataccaaatgcacaaagaaggatacttttacccactacaaaatatggacttatctgaaaatttttatcgaacacatttttcttattgaaatagttacctatgtattagtacatatattttgttacgggaaattcaaaaaattttatatacaaccaatcaaatggctaattaataagtggattaagacctttgacctcaaaacacgaccaagtaaaataacttcaagttgattgataaaggcgtactataaagagtagacaaattgctaacatgcgcctaagcgcaccctatatatcatttactgtaaatttccgccgggaagaaaagtctgcgtttcttcaccaaccctacacgaaccaagatagatagaaaccttctccttcttctgcttcttttatcatcggagaattcgaatcttcttttcctctttttgagattctctaattatccttttggaagaggtaattcgctatcttcttcttcttcttcttaccaactcgcttaaatttctcttttttgggtctttccccgtatttatctgtaaaatttgtttctagggttcgatttcatgccgattagattgtgttaacggatttttcggagtttattgatagttatttcagtttgaaatccattttaggggttacgatcgttgacttgtgataagtctaggtcaccaaatgtatcatttcttagtgtctcgatttttatcgaattatgctctcgtaatgaaacttcatcatcatgtagatgaaggattttactcttctgatacaaaaatttgttttttgtgaaaaaaaatctgtttccttttttgttctgcttaaaccctataattagaaactttcgtcgagcatttctctataagtttgtacagtttgctctatttcatttggggaagaaattagttacttctaaattttcgtatgttataaagtcttgttctgcaacaccattactgacgtttttgcgttatgaatatactgatacagtttcgtgtgagagagaagcgta

SEQ ID NO: 120 - DNA, 3000 bp, Arabidopsis thaliana
tcttgttgtagcacttgcttacctcggtggtattactgacagcatataaagttgctccagctagaacaagaaaatctcctttaacaggattacttccacctaaaaaaacgcaaccattatcataagcgtagattgagttttacttgcgtgacaagtaacgaatgattagtttctaccatttacctgctcgacttcctgcgtgaacgtcagagaagagtaccatgacaacaccagcaatacagataaatacaccactgatcttcattaatctgtattttgttttcaggaacatccaagttaagaccaacacacaagggatcgcccagcaatcaagtagcatgatactcgtaatcgatgtgtactgattcgccttcaccactgttaaaccaaagcaataatgaagttttattcaaaatctcactacaacagcaaccaaaatgtaatggaagtatatacagtttctaagaaaacttgtctccaaaataacttcagatcagtgctcaagccaaagaagactgtgtcaataagaaaactgaccaagaaaattgccttccacgtcaactaaagcaaggaggaaatagtgataccacttcccctacaagagtatttgcattgaagattttagtagcacatactagttacgttataagcactcaatagtgcatgtaatcttgaaaaaaactctcattacaccaaaaagagaaattagcagtaagtaacacaaagtgaaaccaaattcaatactgaccttaattgttggtctccgatagagcatgatacctccatagacgactgccagtaatgtataactgaggaacgtttgtgacgttggagcatttattcctataagatttcaaaattttaaaccatgaatgtataaaccataaagatcataaatctatatgatcgatcgaatcttaaagctagcataaacgagatgcatgcattaaaaaaaatagaaacagtaaaaccttttctggcgagctcagaggatgtgaaggcattagaagtacatagaagtgagaggatctgtcccaagccaagtccaattaaagtcttctttgttttgttcatctcattgaaatcgaaacccattgccattattgcagaagaagctgagatcttcggtgaatctataaattacagacattcaaatacaataagagattcgcagacggcagatcagaaaggatttgttgttgctgtcactacctaccgttgacattttttaagcttttctttttctccttctcttttccctccattcaactaagcttagttttaattaaggtaaagtttgtactttttgtatttgatttcaaacatttgtctaatatgaaaatgttaccaaatataattagtttgaattataaccgtgttatatagactgatccaataaattaagaaacataaattagtttaaacaaaaaaaacataatgcttaaataaaatatttaccaaaaggaaaaaaagaaggggaatgaaaaggaggagtcagcaagtacatcaaaagccaaaaatgacaagaagaaaagatatcacagtaccagcagataccttagcgaagcaacctatccaaggaaacactacgttctgttattattcattttgtcccatctgtaattgcctttgattggatatgatttctatcaatgaaagtagacgttaaaaaaaaaaaaagatatcacagtacgtggaaacacgtgacacatattttaaagggaaaatataaacgtgaaatgcgtggaaactggcaagtagactattaatatttatgggcctatagtggttatatcaggctttattgggctctctatacgaattaaaagcctcaaacaaataatagaacttgaattgtaggcttttgtacccaccaaactggccgccggtgaccccctctcacgccgtatctctttttctttttcttgtttttttttttttttttttttttttttttttttgtgtgcgcgtatttgtttcaccatcaaaaaattaattttgttttaagtgttttattttccttcgttttgtttaaagtgtttaaaatcgttagttcaatgttgaaaaatatacaataatagaaacaattgtgacttttgtaatttgaatgaacaaaacatataacaataagtcctataatataaacattttaatttacattttcaactttttctcattttaaatttttattcagttgaaggcttgaagcgttggactactttagagaaactttacaagaacgttcttaacatctttttttctttcctttttgaatatcaaaatcagttaaaaacacttttgatctcacagaaactgatacaaagccgacggaaccgaccagattaggtcaaaaacgtaaaagacgcgcaaaaagaaaagaaaataactcataatagaatgttttagtcagaagaaaaaagtacaatatgaccaacgtaaacaaaaaagatgttgacgacataaagaaaagagctacagagacaaaggcattaaaatatcttttgtcgaaatctgaagatatttccttaagcgcgtttgcttctctgtctcctccattccattctatatcatctctgtctttgctctaagctttcctgtcaaaacaaaaattcaattccccacgtctgtcttatccacaataaaaccgaccttagcttagcttagactcattactcatttcacaaaaacagagagagaaatagagagacatactttacaggtaataattatcttgtttaattgtattatatatctctaactaaatttgggataaaaattgtctattcttgatcattcctctctgtatctctctgcttttgacaccttctcttagctgttttttcatcttttatctctgtttttaaaatcttttggctctttcgaagggtttcgagtccttttgagttctttgggcttcctcccaaatttctccacgagctcgacccctttcgtatcttccttctcatttttttgccaaatttattcgatccgtctttcact

SEQ ID NO: 121 - DNA, 3000 bp, Arabidopsis thaliana
gaatacacaggagctattgacatttggtctgttggttgcattttcatggagatacttagaagagagacgcttttccctggtaaagattacgttcagcagctgaaacttattactgaggtaagcaaattaaaaccttaatccaaaatctatcattttggtttgtgtgtgtgtgtgtgttggttgttggaagcatttctctgttttgttttgggttgtttttagctcttagggtcaccagatgactcggatctcgacttcttgagaagcgataatgcgcggaagtacgtaaaacaactcccacatgttcaaaaacaatcattcagagaaaagtttccaaacatttccccaatggctctagatcttgctgaaaagatgctagttttcgatccttcaaagcgcatcacaggtgcttatcacgttgttttactactttgtgatgctataaatggaatgtgaaatatactaacaatatgttttaatttgacagtggatgaagcattgaagcagccgtacttggcaagtctccatgagatcaacgaagaaccaacatgtcctactcctttcagctttgactttgaggagacagccttagatgaacaagacatcaaggagcttgtctggagagagtctttacacttcaagaatatgtaatctcccaaattctcactctcttcataatttttaagacacttgaaagcttatttgtctaagctgtggggaatagtgaacatgactcgtattctcgtgtgcatgtgtttgttttgctgatggttggttgtgcaatgggaaaaaagttcttacccaaacaaacccttaagcgattgcaaataatttcaacccgaccaatctctacacaagataaagctaattcgaccatactctgcctaaatcaaatctaatttcaccaaattccttaaaagtcccaaagattagctaaatcgtcctaaagcaaactctcttatttacaaaactagctagctttttttaaataaaaatgtatgtaatgccaatcgattgccgaaaggtaattttcttgttttatattgataatttggtatatgatattagtagataatttgaattggaccaagcaagtcaacatcattgcatatgtatttttaataattaaacgtgaaaacatctccgaatgaaaccgtttgctacaaaagccaaacacgtcttggtttacggatgctggttccaaagaattaataaacaatatctttgttgaaccatacatttgtttatagattatgttcctttcttaaataattcgagctgtcaaactaagttctaatttaaacttatttcaatccattgttgattaaaattttgatatatttatagaaaatccattttcttaataaaaaggagttgactaggttttttaatgctggcccaagaggccaacagaaaggaaagtccacttttgtgcttattataaatttactgaaacaaatatcaaaatagtaggtataaaacatttcaaaaactctacaccaattgatatacgacatttttttccagttaaaaatgctaattatagccgaatacaatacaaattgtaatccaccaattaatgttatatacatgaattcttcattgtattaaaaaaatgaatcttcactttatctagttgaaaacttaatgcaaactaacgagcaatgggttaaatgaaatgactcatcagacgttgggccatcgtgggcttggagtaaactgaaaatggaatatcaatgttaaacaaatttctcgattactagaataataaacaccaaaaaagtttagtgagtaaaacattttttttttctttctgtctaacttactattttttcgaacagagcatatagcttttactatttttgccagcaaaggatggcctgtctctcataaagttattttacggcctaaaatgtcaacgtattgtaacaggagttgttaatgtaccctaaaccttataggtaaaagaaatgaatgagagagattaaataatcttctccgaagaacattaatatgtgccacgtggcgctatctgctgaaacgcggcacagttaattactgtacttggaaccataaaacaaaaaaagcctgttattaattaaataattttttgaaaaaacattcgacaacaaagcgcgtggagttaaaacgtgggacccacaatgacgtcctttttgttttcctcacctcatttgaaaatatttccaaaacggtgagtaattttgccgtcgtctaacaccgacgtcacccgtaaggcgattggtgacagctacaaaaatgttactatcatcagacttatctttcaatcaaatataatcataatccaatttaatctaccatacctgtcaaaccatcgagtaaaaaacgtgtttgttgtagctaataaaatttttaagactaatactgaaaattgacaaactagaaagatgtttggcagtatgaaaataattttatcaagaagtgacataatctttaatcactcaaatccattgctccattaacgccacgtcagatcgacggtgcttgtttccgaaccaacggacggtagatgacaaattaaaaagttgaccatgctcaagtgtttcgtgccattacgtggcgtcttctgatacgtttgtcttcaacactagccgtacgtttctgttctcctcaggaagaaacatttgtctagacgtggctggttttaattagacgcgctatatgtaatgtaccgtgaaccttgtcgtagacgataactatacgtttctctctgaaacaaagaaaattaaacaactttttttgattacgcgatataaaaaaaggcgaagaaattaagctttctctgtttgtcactaagctctctctctctccttcttcttcgacttttttttttcttcctctcttctctttggttttttggtgttgggttttatctgggttcctgatttcttcaacgaggaaggaaggaagaagaagagaaaagggacaagcgagaattactcttttctccttcaatttccg

SEQ ID NO: 122 - DNA, 3000 bp, Arabidopsis thaliana
caatattttaaagttggcgataaaatgatgagagagatttaaatgcgccattatgcattaattaatacaagaatctttatgggatcatgtgcatttccttaatctaatcttttttggtgacagtgtatcagatgccaacatgtatttgaaacaattttttataattatagtataattgtagtgtagctacgaccaaacaaagaattacccgtaaagaagagctggctatgtggccatgtgcttggtgcttcaatttccttataaactactcacttctaatggaaaaatggctcagaagaatatcaactaaaagtagataagatatattgtctttaagctacatacaagttacaacgatccatttattagtgatagcgttatcattttatttttatactattgtaaatttactagtaaactataaatgttatatacggaatgaacgtttagatatctaatatatttcctcaaagataaacactttcaaagagatatatccatggaactgggtattatatttgtatatacgaactttactaataagtaataagtatatttttataatcgatatatacgtaggctatagtgggaaatataaaattctgggcataaatatggctactaaaattttaacattaaacaatgtacacgaaattgtttagaattgttatgtatgctgtaagttccaacgaaaaatacaaaactatgagcaagataatatatataaataaaagaaacgatgatatatcatttgtaagcataagtatacatattacttttctcttttagtgttatattagtgtaaataaaatatagtgagaaaagggaaaagagagaggggatgcatgtgactggcacgacatgaaggatagtggttcgatgtttggactttgtttaagtgttagcaaacgatctttcgttgccatttcacgttgccacatatatttttattaccttttcattatttttaatttattttgtcaacggtcgaattacggtattttatgtacacatatatgaatatatgataataccaaaaactcaagttggactttgggaccgactttcgtgagggatcttcctattgagtgaccacttctaaattgaaatcataaattctattaccaaaaaggtcgagactaatgcttagattggtagatgcatacatatttcccttgatatgacatttaaactctcaatccggcttgattagctcgagtgaaagagtatcaatatatagtttagttatatattttaaaaaatgttcttgattatattttatgaaaaatggatgttttcttatgaaagttttagtttcaaattttgtttgccttatctttgttactcggtatatatattcaaagcgtgtaattacatagattgataccttgatcgtttggataggttaaatatgtgtgtgaatgtgcttagccttgatcgtttggatatgttgttgtatttgcgttaataaagtagttaaaaaaaatctatataacaagagaaaaaatgtaggttctttgagtagatttgtgaaattattttccgattgtattgttcaccaaatgatcctccactttatttgttcaagtaaatgatcattctgctaactataaacaaaaaagaaatgttcatgggataatatctcttgtcgaaaaaacaataaaaaattatatgaaaactattttttttaaaatcctattatgtaaaatattgtttattgtttaaatagaaacgctaatgtcaaacgctaaattagcattcttttaactttgtttcacacaaattaaaagaaaatactgatttttgtgagttcagttttttttttttttaaacattaaagaaacggtaacagtgtttggaccaaaccaaaaattggaacgggacagtttttccaataactttttgtgctactgttcaatgtagatgggcttttaaatgtaaggcactattgagtctggcgttttcaaagcccagtaggagagatgtgtgatactttttagtttttaaagaaaggaaaaagggcttttgagctgctagatagagaaaagtaatcgatataaagacgtttgactcagaaaattgcatataaaagttttgaagctttgcttggaggaaaagcaacaattcgtctttttggagatgagaattgacttcacaacgcatttcattgacttttcgttgtaatttgtaaactaacccttacgcaatttacttgcaacattcttataattaacaaatatcctattcatatcccttcaagccttttctctctttataatttttttgattatttccagaaacttgtgcggaaagtacgttttcaagtttgatatcttcacatactttttttttaaaatatgaatgaagaaccgtacgttgtgatctatatattgtaggttaaattattgtgatccgagtaagttatatcgtcacttatcaagaatttttggtccacataatttgttcaaatggatagaaagttcatctaataatatcgagttaaaccatttacgaaaactgatgttgttcaaatttctatgaatttcggaaatcgttgggtgtcggcatattatcgatttcatatttgaaaatataaatatatcgtcaattataaaatttgaaacattataacggatatgaaaaagatgatctgacataaacttttggaattaattactatgctagaaaattctatgagattagtagatagataacttggaagaagaaaaagggaaaattagaaaatgcagcagaccaaagtagtgataggtggtgcacacgtttttggtgttgacctacgacaacgacaacgacagacaaaaatttatcatcatacaaaacctttctttgtctttatctcattttgttttcttaatatcctctgtttcttcttctaattttctctgtttttattccttctacttctgagatccataaagattcatctcttattacttcatcggaaaagaaacctcgatttcagttttcttgatctctcta

SEQ ID NO: 123 - DNA, 3000 bp, Arabidopsis thaliana
atggaagaggattagcgagcatctgttttggtgataagttcgaaatgaatgtaatagagtatgaggtattgctgagtgagttattgaaatgggacttacggtatttataagatataaatttttatgtcaaaaaatatggacaaaatacaaaatcgtggaatccatgtttagtgattatgatgatcccataattataggagaatgtttaccatttaccatataagtagttatttaattatgaaaatcgttaagaaaatttatgaaaattcaaaatgaagatccaaagtaagtatttgattacctataattatggagaagtgatatattcaaattcaatataggaatataagcaatgaatatttgaaattaatgcaattcggttgatgaaatatagacgcgtgatttttttattcggttcaactcaaaaaatcaacggctcataacactgcatttcaatttccaagattagatgcgataatctgacttttaaaatcctgctctaaggctatcaacaatggttttttcatttaacaccctccacatcatcttctctctcttccacatcctttcctctttcttccacataataattcaatacccactcaaattttacactctacaatggttttttttaaaaattcaacaccctaccccaaaacattttatttcattatttttcttttcttttatattttaaatggataataagtggaattttagttgttaaaggagttattgtggggatccatttcactgaaaaaaacagaataaaaatatagacacgagtttaccgactaataaaaaaattatagtgaaaataaatatatttttttctgtgtccaaatcaaatgaaacaagtctttatttatagagtttgaaaaatgatgaattttagtgtaaaaataatttaaaacaaataaatattttataagataattgatttctaataatttagaggaaaataaaatatcataaatctcagtagcaaataaaagagcaacatatgtcctatctttatttaactctccccacaacttctgtctccaatcatttaaggacaaatggcaatgaggggtccatttttaaagattcaacaatgttgaatcggttcaacaccatttaatccacatacgattcatttctttattcaataccccattgtaagcattcaactattgaataatttttttcaataagccattgtagatagtctaaaggatacacatatttctaaacggattttttcatgacataaaatttttaacccgatagcaaatttgttatttttttcaactttctgtccacttaaataaatgtatttttcaaataatagtattagataattatcattagatagattcatatattctaataaataagattgttaataacatagcattcaggcacaataaaaattattaatctaatatatatataattatgataagatcataaattgatatctttcaatctaaacttattcaatgaattctttcaccataatgattattttactagatatttatccgcggtgtaccgcgggtgaatatgtttatttaaaattatataaattttttataaaaattattatttgtatatgaatgataaatttttgacacctaatttttatatatgttaagcttgggtaattcatgttttatcttctgatatttgttgtacattaattgaatattaaaattcagtatttttttgttgttagagttttttagaggtaataaagatttaaaagttgtattatctagagattgacccgcggtataccgcatgttaatatttttgttagaaaattagagatttttattttagttaatattatttatatataaattacatattcaagaggtacatcataagcctatattttaaataaaaaaattgaattttttttttaagatgatttatagatacatgctattttttttatgtatgatactatgatacacctcatgacgattttattaattaattttctttttgaaattttaagttatatttgtttcgttaatatttttttagtgtttaaaattatataattgtattttgatttttaattctaggatttcatccatagtataccatcccgtattaatatcaatccaaacccgtccaccatttaacctcgtcccatgaaattaatcatcattttgtcatttttttattaagttcgaatatttataatattagaaacttcaaaaagttttaatatcgattcaaacttcataattgcatattgattgttacatttaggatttcacccgtaatatatcgtccgtattaatatctttttaatatttatatgtttaaacttcttataaagttcaaatatttacaaaatttaaaactttaaaaacttttaaacaatgttaaaatatgctttgtttgcaaattatccaaaaaataaaaaattagtcaacatcaaagttaatgcaatacaaacattcaaaatattgaccattgaccaaacgttttgacatagatttggaaactcaataatagtttttaataaaatttggtaagtagtagtaggtgtagttttatggaaatcttaaatctcttaacctatcttaaatgtttttttaacaaaacaaaacgtatataagcaaatttaaaaccgatgtgaaaggacttttttttaacataacgtaacagttgaacaaggaaaaaaaaaagtcaagtcgtttcgcttggccttgcgtttttggcggctagtctcaaatccatcgattccaacggatcattcattctctctctctctacaattatcttcttttcctttttttttctttcttcttctctctctttctccgacctcctccgagaaacccatctctcctcctccatttttgcccttggagtttcatcagcaagtttctcggagtctcgtcggagagatcggagttttttttttttttttttcctggatctgtcgactatgtgatgggaatccaataacagagaacgcagagagagtgttttcgg

SEQ ID NO: 124 - DNA, 3000 bp, Arabidopsis thaliana
caacaaaccacaaacgctaccattctaacaaatccatgataatctctaaaattctctaatcgcgagtggaaaacaccgatgaatctaagctaataggataaatcaaaatggtgcgatggtggtggtacctgaatcttatcggaaaggtaagaaggatctgggaatccagaatcgctgtcgctgctgcaccaggaaccagcaccaccgctaccacctcccgtttccagaaaatctgtaaccattaggcctaggtcatgttcaccgtcgtgactcgaatctatccctcgattcaaccattcctccgccggaacaactctcaagtccatacccatcgttcccaaatctcggtcaattgttcaaatttcaaacccagaacttatgaataaaattgaattgaattgaatttgagtctgtacaaaataaaaaacgcgtatcgtcccctttcacgagtcttgtgtgtgattgattttattatattatatagcgatgagagagacagagcttgaaggttctttttagcgaaagagaaaaatccaggaagataggcgaaaaggaagatgaagcgaagatgaggttaatataatactcatgttaaatgacaaaaatgcccttatatgattaatgatattaccatttgagcttgctgtggaagctgtaacgaaccgaaaattaaaaacagaataacgaacatagacggagaatatgatattattcgttttaccaaagaaactaacaaatagttttaactttatctaacaaaggggtaaaacgggtaatttgtttgggatgaggtggagcgtagcggacaatcgagaaattaaaagtttggcttggggacgaagttaaaggtgggctttaacgttttaaattggctgactcggacgatatttcttgtatttaataccaaaaatgaatgactttataattcatttgtagattgaaagttacgtattgattcgaaaatcaacacattgtgttttcaagtgggcataaactataacaccttgttgattgattaatagattacctaaagacattatggtttattactggtctttcaatatatttttatcgcattgtcaatgatattgtttttgtatcccaagtccactgttttggtctctacattcattttgattgggatttatctttttaaaatttcttctaatgttttttcgatatggttattacttgctttgattttcttttcagtatgtgtattgctttgcaaattgtttttttcttaagatgaaaaacaactcattaaattgtttgagaaatactactaaaacaaataaacaatgaggagaattatggaaaacaaagtgtaataggctttaattcattgctagtgggctttttgggcctatgggcatattacttaccactatccaacccaaaatgccaaataaccgacatgtctcacacaatccaattttgggccatacggccgaaattatttaaacctgtgctcataatttactttacaaattattacttttccataaattgtggaaaagttatctgtaacatccgattcaactggagtctagactactatagacattgatacgttttgagtttttagatacttggaagatatatgcatttatgaatacagattacagacacatactagtactactgtatgtctgtatatggatacaaaaaaaatcatgtatgaatactaaaattttattagaaatctatttttcaattgttgcaacaatcaagttgtcaaatttatttttgtaaccgttaaacaaacaaatatcgatttaggtttctaatctgaattgacatctcaaacaaaaaaggctgaatactttctgaaaatagtgtatggaatgaaggtggcttttagagccattataaccggaagaaaattcaggtgacttttagaaccattataaccggaagaaaaggtgaattttaatttttagctgtgtggaagacacggcaagtccaagtagtaccttcgtacgtcaatattgtccaaccggccgtgtcgaaaatcttcttgagaaaaattggattttcatctataaaaaaaaaaagtccaagtaataccaaacaaagacagcgacgtgtaaaacaatacaagactcataatcacaaacctaccacccaagtcaaacctatattccatttagtgaattcttgattatgacttcttgaaatcatttgtattcatatgtataattatttaagtcatttttctgtaagtaaaatttttatatatctagaataacgagttccctacgacaagatacagttgaacgtaaatgtgacatctcaattttcattggtgtctagtactctagtgattaggttttcgacatttattgtactgattaagtaaaaattcatggtacaaacatcgaatatatatttttctgcttacacacaccaattaacgtggatagaccaattgaaatattttgttacgacaaagcaaaacaaaacaaacgtcatgtttcgctgtttgtttgtcgtcccgttaatggtaatctttcagacacatacagtacccaaacaagtaatttgactaaaattttctctctgtctaaatttcagaagaaaaaaaaactttaggatatattgccaaaagatcttaaaaatgggtcatatcattttgatcatatagaatccaacgacctttatcttttcgccgaactatacttttttgtgtccatttgtttgactttctttcacacacacatccacaaagaaaaaaggaccattcttctccttcttctagtcacccctcgtgcctctctttaacaccaaacccaaaactcccttctctttcttccttcctctccgatctccgttcacatctctctctcatctttatcttcttctttttttgccttgtgggttgaaagtttctatattttctctttctcttctgtttacataatccattttcagctcaagcagctgaagaataacgatcaagaaccaaaaaagaagaaaacgaatctgttcttagctttg

SEQ ID NO: 125 - DNA, 3000 bp, Arabidopsis thaliana
aggcctcactaactgcactctaactaagtcacagcagctcgaatttgctacattccgtcctagattagatacagcttaacttatagctaagagttaaaagcttattattgtttgatgatatcaaccactcatctaattatagcataaaaactcttatccaaatccaggtttaccaaaccgtttgctttgttatattgtaataagaagattatcatacattttgtatcagtctcaagtaaactaattccggtggtttaaccctcttggttctctgtgttcataggtgatgcatttgtgggagggtttctgtcccagctggtgcacggaaaggggattgaagagtgtgtgagggcaggatgctacgcgtcaaacgtagtgatccagaggtctggttgcacttaccctgagaaaccagacttcaactaaatctagaagtcgcacaaatcatccttttagttttatctctgaatgagattttggtgattattattatacgacccaaataaactctatgttgttttcttgtatcaccttttgaggctttaagctattattgagtgtgtgttttggcttggttttattgtacctttttatgattaataaatattattactatactaggccgagtatgatattccaaatgtcaaaatgttcataacttgttatatcttcatggatgtaattatcctctatttttgtttgaacttgcttcatttcatgaaataattgaatgatcattattccctataatgtacattactgttatattaactagtttctctgttcgaattctatttggttcggttcaacgaaacaacattggacattcctatgcaaagaaaatttgcagaatcttttgtgtcggcacatgtatagaacaatttctattgaatcatggaaatgacaagtataatgtctcgttttggatgtatttgataatgtaaagtaggaccagtatgactcgtaaaagacttttgactttggacgatatcaacaactttgacttttacttcacttgtacagttctactttcttatcttctacgtatactaatcaaacgaatttgtgcataaattggcatgggaaaggccacgagtcaaatatgatttgatccattttagttttaacatctattggtacgtacgtgaagttacgagatttgagtgaaggcgaataatatcaatacgaaaagtacaaaaccgggatcaaaccgcaaattgtaacacagcaagcgtaagcaacacgacaaagtggtatggattagtttaacataatcgtataaataggttaagttaccaaggtttaaggtatctcaacaagtggtacaaattaccaaacaagattttaagaaacatatagatcaatcgggattcggaaaccaataccgaggatttctttaattcattattttttgtgtgaaaatgctaaactttgtcgttaaatttatgtactctaggttctaggaagatttaggaaatctcctaggtgacccaagtgaaatatcccttccacttccccattgcaaatctcatgattaccataaacaaataagattagtagtagagaactatgcttgttaacataaacattaatgtaattatgtaagattatattttgaaccactttggaaagtggaaaccattttggcatcatgggccgactcacccaccttaagaataaaacttcgtattgttatagattttcaatcactgatatttaacaatggtttttttttttttgcaacagatggttgatgttagatgatagtaagttagtaccattaaatataaaacaacattaatgaatacttgaaaattataaaactgtgactatattatctatacataatctataaaaaatatttatttttcaaaagctcaaacattggttgagttgtctatcataaatgcataatcatatacatcttgagtcactcaccgtcgtttattgtagactttgtagatagttttattttgtatgttaaaacgtttcaccatcgtttattcgcattccattaatttgaagatttattctgtcatagtaaaattccctaaacaatagaaaatgatgttgttgaaataagtaagattttattactaaataagaccataactcataagtgatttagatacactgatcgatctgttggctacttttctaagcacctcaccgttgaacaagtcaaaggaaaaagaaatgaaaacgttgtttttatgtgtgattgtgtgtctaataaaagaatattaattttggaaacatcttttaatagtaacaaataattcatttgttttgtccaatttaaattctcagttcttcgttctttcgctgactttagctatctctctctgtaaagacttcgttttttttttgttgccgtgtgacgacttcttcttcctcttcttcttcgacctctttctctcggaagcttagcttcttaaaatccatttctctcggaagcttagcttctcaaatcctcgatctcttttgtatcgtgattcattaaccacttcatgataattataatcttccttctcttctgacgattgaattacatcttcttctgatagctgttctgatttttttctgtatacaaagtaaattcaaaggtgagagttgtgtcatcttttgctttttatatacttgttcaataagtcaaagttctttatgttgctgttgggttttagtttattggaatcaacttgcgaaatttgattacttttagcttcgagatcccttctattactcactggaacttagggtttgtgttacttggaaaagaatttggatctgttgggtctaaaggccttcctctctgttaagtggttttgtacttgggggaagccttaactttggaaatgcttgtactttgcagattagttgttcgataatatgcttcaatggttttgattttgtggttcggtatatgttatatgatcattatcagtgttttattggtgtcctgcagtggacaaacatcggtattttaatctcctctcgata

SEQ ID NO: 126 - DNA, 3000 bp, Arabidopsis thaliana
taaattcatgattttggtttttgacctctatcctacatttgtagttcgtcggagacaaggttgcctatgcacttgctcaaggtttgaaagtgattgcttgtgttggtgagactcttgaggagcgggaagctggatcgaccatggatgttgtggctgcccagaccaaggctattgccggtatgtatattgtcaaacatttaatctctttttgctatctcagttcgttctcgtttacagtgagacctgttttgatgatagtgatgcccgtttctacgcactatactcccttagtgtgtgattcaaaccccacagaaatatttgttggctaaaaaactctttttgttggtaatggcagatcgggtgacaaactggtcaaatgttgtcatagcctatgaaccagtgtgggccattggaaccggaaaggtcgctagcccagcccaagctcaagaagtaagtggttctcgatgcgcagttgcactgtaacgtgttgcatatggtcatgatttaataggaaaaccaatgctgttttccttacgagagcttgtttcgtttatgaacaggtacacgatgagctgaggaaatggctggccaagaacgtgagtgctgatgtcgctgctacaacccgcatcatttatggaggtagatagatgataacacgatctttaattaaacacccctatatagttttctatgttacttagcttgattatgcaaattattatcaggatccgtcaatggtggtaactgcaaggagctaggtggacaggccgatgttgatggtttcttggtcggtggtgcttctctaaaggtacatataatatggtttctcttgtaatgatatctttcgtttgtctctttcaaaaccatgactaatgttttcattcttggtctttttgcagcctgagtttatcgacatcattaaggccgcagaggtgaagaaaagtgcctaatgagctcattaagcaatttaaaagtcctttgcttttccagtcgcaactctgaaaaaatgaataagttggtattatgatatgatacattttgcttcagttgtatttggcaaaagtttctctcttactatattgttttgagaacgcaacaatcattttcttcgccatttatttagctgtggacttgcaatttgcaaatcccttccttttacagtcttctcaactcttcagagaatctgtgtttggagttcataacccctcgggccttttgatcaaacccctatttctaatgtcgtccgatcataaacctgtgtgttatataatatgttgtttgttccattttagactttggtattttgtcatgcttgatctctgaatcatgctgtcaaccactttgaaaatggctttacttgttaaataaatgacgagagaatacaggagaagtgggaaatgactttattttttcccttttatcgctttttgcctattggtctgtcatttttgacattttagcttttagaacattattattttcaactttattgtcatcatcttgaaaaatgtccaacattacgaaattattatgtagagagtaaaaaaggaaaagaaatttcatggagaaactcattgtattaggaatgtcaatgtttgtagaaaacaaaatgcttatgtaatttgagtaaaacggctcagtggaactaaagtgataatgtaaaagagacggttaagtccaaaataagagctcccgtatgtcagaattgttcaaaccatttattaaaaaattggactcagtatgatgaaaatgtgtatggattttgatccgaccacgaaaatccaactagtgccaataaaaactccacaatatgtgactcagctacaaatgtgataacgtattatctcccaagtcaacccacatttctggtgacttatattttatttatttctgagtaatatttaagaaagtagggattgaatttttatgagtattatattatatagttgaccttggacttatttgcgtaacgagcaaacaattgtgaccttagaaatggaggtttgactaagtcatcgatcatttcagcaatagagtaattttgggtccgtatgactcaaaacaagttttggtaaaaaatttctctgttttaaaaacttgtatttataaaacttatgtcccatcccatgatactaaatttaattacattatacgtatgtagtcaagcataattttttcctgaaaaatcttatttttcttacctacttgtaaactttaatttaattcctggttaagtagatatttttcttagttcttacaaatcttatattttcttacctacttttataaacatttttgagaccactattactaaacccgaatctgtttcatcattccacacccaaagcatataaatcgaaaatatctatgatcacatgaatatctatcattttcgacaaaatttgtccttttttttctttctttttgtatccaaccccaccacggcgaatttatttcaggcctattaaagattccaaaatctcatgaccatctgactcagatgtcatatctattaaaaacgttattttgaatcttaaacatatatcattagtgatctttttgcacgtttactcagatgcttaagatcatcaaaatcaatctatgaatttcaaaagttttaaaaatcatacaatagaaaagtcccactgatcattaaattgttattactaattttatttagaactcgtttattatcttttggtcaaaaatataacttttgtctgaattcgttttttttttgtttggacaagaaaaagacctttcttcttccttcggttgcctctaccatctcatcaacacacatcttctctttctcttctctcatcctctctcttcttcagtgtttactttttctctttctcttttttttttctctttattatttcgctttaatgagttttatctgatagaatctgctccacccaaaaacagcataagaagaaattcattgtcagagaaaagtgcaaaaaaaaaaaacgatcttcttcatcattctactaa

SEQ ID NO: 127 - DNA, 3000 bp, Arabidopsis thaliana
aatcactcgcttcctcggtttcctactcttctctgtctttccaggtaacgccagttttgactcattcattattcggaacgtttttgttttaaaaatttttggtgctgttatatttttcacataacagattgattttttttagaattaggtctcttgaatcgaattgtagattatatagtgttactgtcttattgactccaagactgtcaaattttgacaacaatggcacaaaaatagcaatggactatgtaaagtgaatgagttaagattacctaattgtgaacaaataggcttgtaacaataacacattgtagtgttgcatagaattcgatcttctgttatctctgtattcggtaaaagaaattcatagatgttctaaaacttaacattttactaaaaaaaaagcacattgtagtgttacttgagttgtgagcatttttagcaaccaaacatgtttttgctctttttattgatagaaatcccaaactggaggacatccctaatttagccaacgagctcaagtttatctccgagttaaaaccatcaaagatttatgaagaagaacaatgcagtagcagtacagagggatattataactctgatctgcctaaaccacgaaagctcgttctgaaacaagatcttaactgccttcctgattcagaaaccgaatccgaggaatctgtaaacgaaaaaaccgaacattcggaatttgaaaacgataaaactgaacagtcggaatcaggtaaatctctttcttcaaatgtcaatagacttgccttccagataatatataactctaggccagttttaagctctcttttttttggtacaaggtccagttttaagcattttggtgattaatttcgggttattgtaaaaacacagatgctaagactgagattttgaagaagaagaagaggacaccatcgagacatgttgctgaactatccttagaagagctttcaaaatactttgacctcactatcgtggaagcttctcggaatctcaaggtcggtctcactgttttgaaaaagaaatgcagagagtttgggattccacggtggcctcataggaagatcaaatctctcgactgtctcatccacgatcttcaggtcttctctctctctctctctctttatcaatcctaatacatcaattcactgaaagaagcattgatttgttttggtattgattagagggaagcagagaagcagcaggaaaagaatgaagcagcagcaatggcggtagctaagaaacaggagaaactggagacagagaagagaaatatagtgaagagaccattcatggagatagggatagaaaccaaaaaattcagacaagaaaacttcaagaaaagacacagggcttctagagccaagaagaatcaagaatctcttgtcacttcctcttccacttaaagactttaggtcctttaacagtaacatcggatatattagttagttaggggtttctgtgaagcgttttggtatttagaaatgttagttacaagtctaacagatgatgctaagccatgtttgtttttggtataagaagttccaagaagagaggaactcttgtatcatgattttttgtggtcggatatcagaattgaatcttttattttttcttagtgcaattaggtagcaattaagatcgaatttctttatataatggtgaaagatcaaacccaaatcatggtttaggaactgatccaaattaacccatccatagtcaagaaaaactttcaaaagtgtgatgaccagttttgtttaaggctattggttatgtgtgttcttgagtggtcccagctcgtgctttgaaaatctacgacgactctgtccacacgacgaagaccatcaattaacgtgtatcgtacaaagaagttcgaagtctacaagtgtgtatacgtgtgtgtgtgatcctacgtcaatatttacgaaaatgagaaaatgtttttctttgtttcattttccatgcaactggcattttgtacgtggtcaagtatcattttgaagtcattttcagtgtttttgatcaaaaattttttttgttattttttggtgaagatcattttttttgttttaatattaaaaaagaaataacaatactttattttctgatctaaaaggcctatatatatatatttgaccaaacaaaaaaagatctatatattatatgatcatttaaaaatgaaaagtatgatgttttgaaaaaaggccaacttacgaacatctctgacaaagtgaagaaatttttttctcttacgcattcatataaagaaaaatatattctaattttgccattggagaattttggtgtttctaattgtgaaacagctctatagactatagtagaagtcgaatgactttcatatttgtggaaatgaatgagaaatttccataaagacacaaacgtccaagcactgtgactgagaggatgacttttaagcattttgctggcacaagcaaaagtctttttacttcctaacggtttcacatctctactattttttgaatgatgtggacagtgattaaaaaaaaacatgtgaaataaaattacaaataattcaaagatttccaaagtaaaaacaaaattctcaattatttttttcagatcacacgatcataaatagatagaaaaggctcttaggctatgattcttctttttggtcccatcttcttggcattttcgtttgtttttttttaatttcttttaaatgagaaagaaatgcataaaaaatgaaaaggtagaccaaaacccttcttcggttcacgctagcaacccccaattttcctccctttattttattttgttatctaaattaagtcaaaattattttgcaacccatcgttgcctctttcaatagttctaaactcgagcaataaaaactcaaataaaccaactgacttgagatccatatccactagctcttgtctgaattggtaaaacaagaagaagaagaagaagaagaagaagaaagagaaggctcattagaaattg

SEQ ID NO: 128 - DNA, 3000 bp, Arabidopsis thaliana
atcaagattcaggaagcagtgatgagaatgaaaatgggagcattggcctgaatgctagtgatggaagtagtgatgggagtggcgctcaggtaagacgaatgtgcaataccgataatctaaatatacacccgagaagctatccttttaaaaatttcttaaccacaaatgataggggtcggatgatcgaacttcgcatgtgcactcagatgcttataaatggtggaagcgcttaactaaccaattgtagaactcaatgatgtttaacttagatctattcagtgataaactgggtgaaaatttctagttcattttgaagttttattttgcacatggtttatctccaaaacctaggttgattttgacatacctttttttgttcagagctcttggacgaaaaaagctgtggatgttgatgacagtccacgagcggtatctctatgggaccgagttgatagcacttgcgcccaagtggtacattctaaccctgagtttccaagtaatcagttggttgcaccacctgctgagaaggagactcaagaacatgatgataaatttggtaaagaaaggaaactgtgatctcttagtttcttccatactcttctttatactgaaactcaaaaacatgatattgaatgtttttcatctattttgcagaagatgtcacaatgggtagagacttggagattagcattcgtagaaactgtgatctggccctggagccaaaagatgaacccctatctaaaactactggcattatgagacaggataattcgtttgaaaagagctctagtaaatggaaaatgaaagttggaaaaggaccattggacctcagtagcgaaagtccttcaagtaaacaaatgcatgaagatggaggctcgagtttcaaagctatgtctagccaccttcaagataacagagaacctgaggcgcctaacactcacttgaaaactttagatacaaatgaagcttctgttaaaatttctgaagagctaatgcacgtggaacatagttcaaagaggcatagaggaactaaagatgatgggacactagttagggatgatcggaatgtgctgaggcgttcagagggctcagctttctcaaggtactttcttagaatcaaacctctgttttttcttccgtacacaaccttttgaatgccttattgaagaactatgagatcgactgttggacttgtgcaggtataatccagcctcaaatgccaataagatttctggtgggaacttaggaagcacttcgcttcaggataataatagtcaggatcttataaaaaagactgaagcagcatatgattgtcactcgaacatgaatgagagtctcccccataatcatcgctcacatgtcggtagcaataactttgatatgagttccacgactgagaacaacgctttcacaaaaccaggagctccaaaagtaagctcagcaggatcttcatcagtgaagcattcatcgtttcagcctttaccctgtgatcatcataataatcatgcctcctataaccttgtccatgtcgctgagaggaagaagctaccgccacaatgtggatcctcaaatgtgtacaacgaaacgattgaaggtaacaacaacacagtgaattacagtgtgaatggaagtgtatcaggtagtggtcatggaagtaatgggccatatggaagcagtaacggtatgaatgctggaggaatgaatatgggaagtgataatggtgctggcaaaaatggaaatggcgatggtagtggaagcggaagtggaagtggtagcggaaacttggcggatgaaaataagatctctcaaagggaagctgctttgacaaagttccgtcagaagagaaaagagaggtgcttccgaaagaaggtaaattctcggtcaaatctataacaaaggaaaaaaaaagtattcttgtaaattgcgaaagcaaatgcaaaccgcaaaaatgttttttttttggctttctcaggtacgataccaaagccggaaaaaactagcagaacaacgccctcgagtgcgaggccaatttgtgcgtaaaacagccgctgcaactgatgataacgacataaaaaacattgaggatagctaacggaaaatcaacaaaacccactatttctcagcccaaaaacatgagtaatgtgctcatatctatcttatatatatatatctatcacatgttttaacattttcccttcaaagtctgattctttgataatactactactattcacgaaacaaagacactacgacatttgattgtttgttattattgtcgttgtctggtctggtttgtgaaattaggacgaagggtttggtttcaggatgtagtgaaatctttgtagatgttgtaaacttgtaaaacaataaccccttctctgtatattttttggtataagcttgcttttggagccgtgcatagtacggtgtcgtattgtatcaacattatctctttcaatatcatttagcttatatcgtaaatatatatattcttagaaaaaatctgtctttgataaacaccattttaaaataggaataatcaatctcttatacccaaatgattggaaactataatggtgaccacgattgttgcttattaaagttcaatttcaatattgttacaacttacaacacaagaaatttattcaatcaaataatctctttttgtgtgttgaaaagaaatttaaattccatgggggtagttagttgatactactttgataaaatataatttttgtttgtctttttttctttgacaattaatttttatttgtcaaagtcaaacccattcacattaatttgtatcacaaaaattaaattgttttaaaaatatattttatatcaaaagagaaaaatcgaaaaatccagcgattggcttggcgtgctttttttacatttcaaagttctctaagcttctctctctctctctcgcttttgagatcatcgaacacaatcgaaacgaagaatcatttgaagaagaagaagatcgtgagaagctta

SEQ ID NO: 129 - DNA, 3000 bp, Arabidopsis thaliana
tccttcagatttgactaagcttgagctattgctactaatctccagcccttgcattcggccgttctgtagaaagtccgacacgctttgagaattggacatctccataggattgaaactagaatgcatctgcatatcatggaggttcattgagccatgatatggtggaatagccatgaaagttgaggaagaatactgaatctgctgcattcccatatcaaacgaatctgaattaccagagatttctcctgtctccatcttcatcctttcaacttctttcctcaacgcttcgtttaaagctgtaacatcaaaaagcaaatattgaagaaatgcaccaaaatgcatacaaagaaattagcttcttttttttttgtgcttaccattacgaagctgagcttgttgttccattgcttgcaacctaagtttcagctctgtgttttcgtttgctagtccatttgtgtctctctggatcaatcaaaacaacattgaaatcaagatctgtctatgtatgtaaaacagaggaaagaactttcctattctgttgggatcaaacgaggaatcgccgaatatggaaacctggtagagagtaagctgagcagagagagtggtagcttcggtttgaagagattgaactttgcgctcaagttcttgaatgtatcgagcttttctctctttggatcgagctgcagattgtcgattcgctagaatcctgtaatcaaatccctaatttcattgcaattcttcaattctgtggaaagagaaacaaatttgaagaagaagaagaaggaccttttggcgcgtttgggatcgatgttccaaagctcagagagtttttcaggaggcatagctttcttagcgtccatgatatcaccggcatacatggcgcatccagcgtcaacggaattgctgtgacggtggcgaggacgagaggaaggaggaggaggaggattagcagcgccggaaacggagttggaggagagggaaggattttgaaagggattgggattagaggtgaggctatcgacatcgatgaaagaagagaagagatcgtcgtcggagggaaggtcgtcggaggaaggtggtgcggcggaggagaggggatccatgaacatgaacatggacatatcgtcggagcgagatcggcggtggaaggaagaagatggaatcggatcggcattaggaattggatcggaggaggggataatagtggcgccgggctttgggactggtggaggatctgatttctccatttttttaagagaatctgagagatgaatgctttggttgtgtgaataattatgattattattcgcaattgagaacaatgtcaatggagataatgatggagatgaagaagacgaagctctttctctctctctctctctctctctctctctatcaaatgaaatgaaatgaagagcgtaggagagaaactcgactctgtgaggagagagaagtgacgtcactaactataaaattgcgaaattgagttgatttattaataattaaaaagaaaactagttgatgaaaagtaaaaggcacattggcacgtgaaccatcgcagcatcttgtctccctcccttttttttttatttttttttcctttttctttgtattttatttaattattcgatttcatgatttaaatttgtttaactttaaatcttctttgtagcattcattacaagattctgtagttgcttcaacgaaatttattaatttaagctgttatggcattacatctccccacgtctgagtgtatatttttgtatctttgagtcaaaattttaacaagtaaaaaataggcagaaagccttgtatgaactgagagtctgagagaatgttttgtgggataataagttggtaacttggtatggaactatctatggattgggaaacaagtaaaattcacttatagtgaaaaatacttattggttggatctaaatcatacggaggccttaattatcaggcccatacaagaagacaagtattgttttgttttaagaaatcctcgagcatataatgcgcctgtagtggacaggaggatgttttgggccttctcttaaattggcaattgggcatcactttgtttaccggtcaaaataattaaaaagatggtcgtattgatcgctttaagtaataagttttttagttaagtctctctaaattgtcttaaacgcaagtagtggaccggcatcatttaatagtgattcaaattaaaaacctaatgatgcttacttttaccagctaaagtttcttttgtcttttttttttttgttttattattatttatcaacatacttgtgaattgtgattctccctttttttatatataaataatgaacatacttaagatatagtttctcccatttattgtcacctaacgggtattttttaaaaccaaattctgttggaaagttcttctctaaacataaataatatatagctcatgtctatgctttttaatagtgcccattgtatttcttttcttatttgagtaatttattccagctgtttcttttttttccctctcgtaatgatacgacatagtgacatacatcttctgtttcttctttttttgttcaagaaaatcataatgactacaggtaattaatcacacttctacaaatcagttgataatcagcaccattttccaataaaagtcgatactttggaaaatttcgtgacttttagtatcgtgggggccaaaatgcacataaagatacgatatcgatgaccaaattgccatatactatatgattccaatataccaatgattgctactatttgctaatggtatacgtttttaaattttaattaatacataaaaaaaaaatcaaggtgggataaaaaggtaactttattgacaatatttggaaattcatcgcacctggcaagagatttacctactgtcattaaaaaaggattaaaaaaacgacaaaaaggtcaaagacaggtcagacaaggaatcattaaacaaaggaagaaaaatagcaagtaga

SEQ ID NO: 130 - DNA, 3000 bp, Arabidopsis thaliana
caaaatcgttgtttagtgctaattacttatacattcaggtgtcgagactcatccaagaacttgcagcagctgctgccgcggaaaaaggactaacctttgaagagaacatggtggaaagactatgtgcttattcacgagctgtttctcatttcccaactgctgttaaagaagtacatatatcacttttatcatccttgatctctctctttcaatgcatgtgcatgtgcatcagtatctgtttcacaactagttttctgattattgcagtttaaatggaggaatggttggttttattcactctcagagaaggcgattgcggaagggcaaccggatccgtgtcccctccataccgaatggctgaaagagcttaaagtgatatagagccagtctttctaaattgtgagtatctggattaagtatcattcttacatattttaagtagatgatctgaaactagtgtcaactgtgtacacgcctgagaagtgaaaaaaagatgtaattttttaataaagaaagagaatcagttcacgctttgtaaaatgtccagacttttatatgtgtaaacttgtgcattttcaagaatcaaaacttttctgcttctagactcccatcaattagggaagactagaatcttcaataataaacaaattatgacagatacctatgtagactctttggaatcatcaatagttgacaaagtaagaggcaggatcgtccacgcttgtttgaattttcagcctttgcaggcaaggtggtccaagtaggcaactgtggtttcttcggttagttactatataacacataattctatattagctttagctttagcttcacataacataactcagttttctacaaagaaaaaaaaacagagcataatgagcagagagaagttttccatatataacttgctctctcttctggttctgctgatccatggtttgattgcagcatctgctcaagatctcactgtcttcagttcttgtcaaagccattgcgggggaatagcgattccttatccctttggaattggtaaagattgctatctcaacaacaatgagtggtatgaagttatctgtaaccgaacctcaggaaaccctctgccagttcttaagagtatcaacagagaactggtgaatatctctctcccggacgactcaagcgatgtctttgggctaacccgaatcaagaatccggtaacttctttaggctgttccaatatggaagaaatcagcttggctttgaatgtgaccgggagcccattcttcctcaccggccgtaatactttagtagcagttggctgtaacaacaatgcctcgatgactgatgataagctgcagattggaggatgcgagtctacctgcgacgtggggtttggtcagagaggacggaacagaagctgcaacggctatagatgttgccaagcgaagatactctctgaccgtctgcaacagattggcatcaagatagagagtcttgatggtaacacaacgaaataagctgggtgcagagttgctttcttgacagacgaggcatattctcctttaaatataaccgaaccagctttgttttacgataagggatatggaacggtggagttaggttggttcatagataggttacacaatatgtccgttgtactggggtttgctattcaattaccgagggtacaagcggttggagttacagtaactatgaagcttgcatatgtagatatggtaagtatttagagcgaagctatagaagctgcaggtgtaacagtggctacagaggcaatccatatctctcgagtggatgtacaggtaaactaacattttctggtataactttgcgttagtttctgtaagctccatgaatcattgatgcattcttcgcctaagtagatattgatgagtgtgaagaagccaaagctgaaggaagcaaccattgtgggaaagggtatgattgtgagaatatcccaggaaactttaggtgtaaatccaacaaaaacaaaagactagccatcattcttggtaagctaccgatcatctgcgatatgtcatcatggatagcaataaaacggatttggctttaaatgtgtttcttttgtgttgggtaggtattagtctaggctttggcttgttggtagccattggagcatggtggttgtataagtttatcagaaagcaaagggagataaagcggaagaagttctctaagcttaatggaggactattgatgcaacaacaattggtttctaacgaaggcaacattgagaatacaagagtattcagctcgaaagaattggagagagccacagaaaacaagagtattgcaacatagaagatccttggaacgtttgtactgattcttcctccaacatcaccaccacatcttcatttggtcgaaacattgtgaccatcagagaccactagatgtaaccgtatcatttgaaattttggtgttattcgatttgtttagttgtatgtattttgttttatccggtttggagaatgttatattgaataataagaaccacaaacatatcaacgaaagtaatcgctcttgactgaatatttatgagattggactatgactagaatagtagtctcattgcatttgtagtactagttgttcgcaacagctcagattcataaggaccaccagccaatcaatagaacaaaaatgaaaagtgaaattatcgcccaccgtggggctcgaacccacgaccacaaggttaagagccttgcgctctaccaactgagctagacgggctttgtgcttagcttaactgttaattgttagatagtctataactgtaggtaccaagtcaaattttaaaatatctcaagtcaatgatctgcactctgcagaaactaaataattgagatgaaaggatccatacatggagttgacttttgatgataaaagcttcacgcgtctatccaaacttctttgaacgtggacttttgtcacatagaagataagagaagatcaatcagattaaaaaaatgcagaagt

SEQ ID NO: 131 - DNA, 3000 bp, Arabidopsis thaliana
gaattatgaagacaaagactagcatcttccaatttattgtagcatctgtccttactctgctcatcaatgactcatcagcagcaacacctccacctccaattagcaattcttcaacgtcttgtaacaaaacctgtggaggaatctcgatcccgttcccattcggaattggcgggaaagattgttatctcaacggttggtacgaggttatctgcaacacaaccacttccgattctaacacaactgttcctttactctctatgatcaatcgggaagtggtgaatatctctctcccagacagtaacgaaccatacggacttgttcaaatcaaaggtcctgtgacatcgttgggttgttctagtaatactagtgaaggaccccaaaactcgctcccggttttgaatgtcacaggtaagggcagcccatatttcctgaccgacgagaaccgtcttgtggcggttggttgtggtataaaggcattgatgacagatacagaatcagagatcttgggttgtgaatcgagctgcgaacacagaaagagtggtgaagaagtaacaaatttgatctgtactggttacagatgctgccaggcgaggctaccggtggggcgtcctcaggctataaccgtaaatatagagaactctagtggaggagaagaaacgtgcaaagttgcgttcttgacggacaagaggtattcgccgtctaatgttacagagccagaacagtttcataacaatggatatgtggtgctagagttaggatggtactttgccacttcgaactctcgctttaagagcctcttgggttgtacaaatatgagccgaaaaggttctgggttctcggatgataattgcagttgcgagtatgattacttctccgggatgagttataggaattgttattgcgactatggctacacagggaacccataccttcgaggtggctgcgtaggtaagtcataagtgattgttttcttcttttgttttctcattagatcatcaataattatgtttcaaaattgtgtagatactgattcatgcgaaggaaatcacaactgtggggaagatgctcattgtgttaacatgcctggaccaatgtccatgtgcaggcctaaccccaagataaccaaacctaccaaacccccggtgcttcaaggtgagtggcaacttttaactattagactgataaagtagaggataatgtataccttatgtttatttgggttgttgtaggcattcttataggtttgtcaggattagtattttttgttgggctattctggctatttaaactcataaagaagcgaaggaacatcaaccgcagcaagaagtttttcaaacggaacggaggcttgctgttgaaacaacaattaactacaaaggacggaaatgtagaaatgtctaagattttcagttcaaaggagttaagaaaagccactgataacttcagcatagatagagtgcttgggcaaggcggtcaaggcactgtgtacaaaggaatgttggtagatgggagcatcgttgcggttaaaagatccaaagttgtggatgaagacaaaatggaagagtttatcaatgagattgttcttctgtcacaaatcaatcaccgcaacattgtgaaactcttgggatgttgcttggagacagaagttccaatcttggtgtacgaatatattcccaatggagatctgttcaagcggcttcatgatgaatctgatgattacaccatgacttgggaagtgcggcttcgcatagccatagagatagcaggagctcttacatacatgcactcagctgcaagttttccaatattccatagagatattaagactaccaatatcctactggacgagaaataccgagccaaagtgtctgactttggaacttcaagatcagtaaccttagatcaaactcacttgacaacattagttgcaggaacttttggttacatggatccagagtacttcttgtcaagccaatacactcacaagagcgatgtttatagtttcggggtcgtcttggtggagctcataaccggagaaaaaccattgtcccgtgtccggtctgaagaaggtagaggcttggcaactcatttcctcgaggccatgaaagagaacagagtgattgacataattgatattcggatcaaagacgaaagcaaactggagcaagtaatggcggtagcaaaactcgccagaaaatgtcttaaccggaaagggaagaaccggccaaacatgaaagaggtttcaaatgagctagagaggatccgttcatcacccgaagatttagatgtccgtaccgaaaacgaagacgaagaagaggatcaaccaatggcaatcaacaacaaaagatgattcttgaaccgcgttcatcagattttctgagaacatctgtatatatacaaaaaaaaaactaatgctcattttgtttgctaggaggagtaattataatgcgtgttagtaagtgtaaaaacctctgtaccactattttttttctcttcaaaatctagggtttccaatgaagaaaacaaaacggacaaagtaaagatttggggatcgtgattcgtaacgatttcggaagcttccttggtcacttcggctgatgaaagagagatttgtgggccagataacactttacgcgtccaagttttgatttcttcagaaagtgggactcaaagagttcatgtcagattgtcagctaccagctaccaacgtcacattacttgcacacttgtacattagaagactaattctgccaaatgttcatacgtcattggtcataatccaagagagtcaaacatgaaattcgttgactcttaataagtactatattttggtcaacattgttttgcatctcttttcacgcatcatccatcttatctcatttctgacattttcgtctatgcagagtcttgatttttgttttctcccttcattaaacaacattactagaatcaaaagatcagatagagctggcaagttgagagaacaagaacaagatcagt

SEQ ID NO: 132 - DNA, 3000 bp, Arabidopsis thaliana
caagctgcaaagacacaaagagtaatgaagtaggtaactcgctttgtaacggttacaaatgttgccaagcgaggttacccgtagagcgtccgcaagcagtaggtgtcaacatagagagcaataacgatacaagaggagaagggtgcaaagctgcgttcttgacaagtatgaagtatttcccgtcaaatatcaccaaaccagaatggttccaggccgatggctacgctgtagtagaactaggatggtattttgatacttcagattctcgctttaggaaccctttgggttgcacaaacttgacccgttctagtggctcttacttcttaaccgacatttgcctttgccgttacggttacttttccagaatgagttatagaagctgttattgcggcagtggctacagaggaaacccatacatacgaggtggatgcatcggtaagtgcctgtttttcttctgtagtcttgaccaccaatcagaaactcaataattatgatttatgtatgtagacattgatgaatgcgaagtacccaacaagtgtggagaagacacttgtgtgaacatggctggaaggtacagttgcgtgccaaagataaccaagcctgccaaactcgctcatgtgcttcgaggttagtcaaaattgcaccttgtgtatacaagaaaacaaacaagaacaaagaatttagtgtaccttaacttttcctttgttgttgcaggggttcttataggtttgttgggacttctgttttttgttatagggatttttgggttatacaaatttatcagaaagcgaaggcggatcatccgtagcatgaagttcttcaaacgtaatggaggcctattgttgaaacaacagttaacaacaaaggacggcagtgtcgagatgtcaaaaatattcagctcgagagagttggagaaagccactgataacttcagcatagatagagtgcttgggcaaggcggtcaaggcactgtgtacaaaagaatgcttgtagatgggagtattgttgcggttaaaagatccaaagttgtggatgaagacaaaatggaagagtttatcaatgagattgttcttctgtcacaaatcaatcaccgcaacattgtgaaactcttgggatgttgcttggagacagaagttccaatcttggtgtacgaatatattcccaatggagatctgttcaagcggcttcatgatgaatatgatgattacatgatgacttgggaagtgcgacttcgcatagccgtagagatagcaggagctctttcgtacatgcactcagctgcatcttttccaatattccatagagatatcaaaactaccaatatactgttggatgagaaatacagagcaaaaatatctgatttcggaacttcaagatcggtagcgactgatcaaactcacttaacaacattagttgcaggaacttttgggtacatggatccagagtacttcctgtcgagccaatacactcacaaaagcgatgtatatagtttcggtgttgtgttggtggagctcataacgggagaaaaaccaatgtcacgtgtccggtctgaagaaggcataggtttggcaacttatttcctcgaggcaatgaaagagaacagagctgttgacataattgatattaggatcaaagacgaaagcaagcaagtaatggcggtagcaaaactcgccagaagatgtcttaatcgaaaagggaataagcggccaaacatgagagaggtttcaataaagctagagaggatccgttcatcacccaaagatttagatgtccataccgaaaacgaagaagaagaagaagaggatcaacttatggaaatcaatagaatatatgattcttgaaccgtcgtaaatcagactttgctttaataaaacattttgtatctatatatacatttttgcagccatcttgtgaaataaattatggagttggaacttatttaaaatggctgccactggcttttaattattgattttttttttgcaataaattaattaataaataaaaaacattccaaatatatttcaatcccatatatcacgcaaatttcttcaaaatttgaattagatttcggtagctatttaaaaaaaaatatttgacagaccaaaatacaattacaatcccttaaaatgagcaaaacacacctaaatacatttcttatcaattcactaaacttatttctccaacatttgaactagatttcgacaactatttaaaacaaaaatttgtttgacaaactaaaatacaattgcaatcccgtaaaacatttattttcattatatatttaaattagcggtgtactgcggttttttttacgggacggatttggcgaaacgggtttggaaggacgttacttaataataacactaaactataaaataaaaataatttataaataaatataatttgcaaacttttatatatactgattttaaaaaataaattgttttcgcggtgtaccgcgggttaaaatcgagtattgtagaactagagttcaatcaatgtgttgctgctacaaaagtaatactagaaaacagaagggacaaattaatgatttgggatccagatttgtcccgatttcagaagcttcgttggtctcctgagctgacgacagcgagcttcgacgattgtgggccaaattactttttcccaaaaaaagaacccaaaaatgtccatatcagcaattagctagccacgtcatatatttgacagttggataatattcagttagcttatattacaaaacactgccaaatggccttgcctcattggtcatcgccattacattaatggttttgaaatccgttgacttttgagcaaagactattttggtcaaacattgttttgcatttcttttcagttttcacgcatgatccatcttatctcatctttgacattttcgtccaacaaatgcaagtcttgatttttgttttcttccttcattacacaacataaaaagtctcaaataacaagaccgacttgacgagttgagaaacaagt

SEQ ID NO: 133 - DNA, 3000 bp, Arabidopsis thaliana
cgaattgaggttaattcactggaaaaacaactccaaagaagagctgatcatgaagaaaaaaatcccaaatttttcagcttaaactttttttaaaaccaaaatcgaattgaaatttctccgattgacctaaaactctttggtcgagtttgttgtgtagttgatagggtcaacgaagcatcaaatcaaaccccaaacctaagaaaaggatgactttttccaacaaagacgtaaaatttcaatgtgcaaacatctcagcgtacgaattcgatttccgagtacttttcatcaaacaagaaaagggaaaacacatgaacaataaacatgcctgggtttggacacaccggtcttctcaccggatttagtcagaacgtcgaagtgctcctccgccatagctctctcttactatctatctccgtgactgtgcgtaaaattggaaaaaggtgcccaatttatagaagagaagaggaggagatataatgtccgtcaaaaacaaggggctttgcttacttggcttcactaaaccggacccttttcactccgagactcagcttgacacatttcacagctctaaaataccttcttacgtcttaggtaggggtcaagagatcaagccaacatttgtacatttatatgcaatgcatgcattcatttcatttttttttaatgttaagacgattatgtcagcagttagttcatgttagttgtgtggattatataatatcaaaaggtaaaattattaagttgttttgtgggtaataccaaagtctcttataagaagatttcatgattcttgcaatagagaccaaaaatgagataactatgtaataatagtaatgacaggtcaaaacgagttagtcaaaaaggtttttggatcatttccctaacatttcttagccacattttcatcgaggactgcatttttattgctcatagagtgatgaaagtaacaacaactacttttgtgttttccacaagtacaataatggtgagaaacaatattcaaaagtactacatgcttctttgttttaaaatgtaaacgtaaggccatcttcatcatttctgaatgagaaacttaataataaaataataacccaaaagtaaaaaagtaagagagagtggaagaagagtttctcacttgagaatcaaggagaaacgattctcagcctaaatcgcggcatgtcaatcaaatattagtttaagtattataattgaaacaaaatatattatataattaaaataataattttttcttttgttgagaaactagcaagggtatctatcccatggagatactctaacaaataaaggccgtgttgatttaggtataggagaaagtacgatttattaaatattgtagcagaaaacaatagagataagttggaaactagacacttttttcacaaataatttgcaaagtaagtagtttttttagaaatagggagaatagacacttttctctttcctttctaatacaattttctatctaatagagattttagtgaatgacctttatagccttctgttgttttgtcatatagtcaaataaagtcaaaaataacttttgtttcttaatgatctaagaagtggtatacggtatagacagtgtacaaagtgatgtacaaacgataatatacaatgatgtataactacataataagatggtgtacgaaaatgtaaaatatggtgtacatgatattaatagtatacatgcaataatgagataataaatcaaaccataaatcaccttgtacaccgtatataatatcgtacaccttcacctattgtgtacacctcatattcaaaagataaaaccatttttgtcaagtgataatatacaaaacaaagtttaaataataataatatgagattagtgtacataaaagtgtacaaatgttagtgtacataagtaaaaatgtataatcattactttcatttaatggtatacaccattatggttaatttaatagtatacatgatggtgtacaccattatatttttattaatttatgaacaattattattttattttataaatatgagataaatagaaatattttagaagatatgtataaaatgatttggtgtataagtgttagtgtacaaaactatgttttaatgctggtgtacgagaattataattaaaaacatataaatcatcttgtttttggaagaagaaattattttttaaaaataatttatttttataaaattcaaaaagatgaatatgaaaaaaaaaataactataatataataaaaatagttctaaatagttaaataatataaaaagtttgacccatattttttcatataaagtaaaaggtaaaatggtatttgacatattttttgtcttttagcttattacacataacctctatttcacaaaaaaagtaaaaaaagtgtctatttcacaaatttctaaaaaaactacctacttctcaaattactttttaaaaagtgtctactattctaataagcctaaaacaataagctgagctagattcacttctctatgtttcttgcgttcatgcgtgtgaccttacaaaagaaaatccaaaaaacgcaactctgactaatgtttcagcagatcataacacataataaacatgcatgagctctacagatacttgttctctttttgatatttaattagccacgttttaatctagagtcggattgtgatagttacagtggaaatttctcctcgcgacctaaaccagtcacgttttgatatttttcttttttctcgtaaataaatggaggaatataaaatattgaaattcaaacaaggaggctcactgaaagcaagaaaagctttcactaggaggactagagaaacaaagactgaccagagaagaaaatatgaaagcgaaattcaaagatgaagacttatgattcattgctgggtcaaactaaacacaagatttttccttcgctcatccttacaaaacccgtctctgcttttagcttttcttgagcagatcataaacagaaaacattaat

SEQ ID NO: 134 - DNA, 3000 bp, Arabidopsis thaliana
aacaagatagtgactcatcactcatatatatagttatgtgatgagaactttgatgataactttaagagttgtctcaaaacaactccctttctcatctttatgaaagtagtaattgaatcatcgtgttctttgtgataacaaagtaatctttcctcttttagtttctttgagtaataaagctcttaatgagctatctaatttcagttttatatttctcttaataagctcatttgagcataaatatcattgctttagaaatgataacaaaaacattagtcggagacatattaaaaacgagatctaacactataactagagatgacaaccgaaaaaatgatacattgacaatttcccccaaatttccgcatgagaacattgagaagaaatcaagtgttgaaaagtacattcgggacaaaaacaaaatctccagtcttaatcattgagtttgggtctttcctctcatcagcggaattcctgccaattattctaatcattccacaaatttcttataaagtagaggaaagaagataaatcattgagcttgggtctacaaaactgattaattgataataattatctgacctttttcatactgatcaatatgataatttaataatgttgtgattgctgaagacaaaactatatatgacaacaaattaattatatgtcttataacggaaatatcaaagttttgtattcttatttatcgtttaaagattccacagtaaccatgattaaaaatgtaccagaatgattcaaatatagtcattcgatcgaccactagatcccaatgaattggtcgacaaataatctttaataacagatcaaacgtttagttgtttcgttagagatattaagctattaaataaagagatacgagtttaaattccatgctaaatgtaattttgagtcacgtacatacactttcaaagtcatggtcaacatcaaactcaaagtcacattccatagtgattccttctaattgagtattgccagtttcaaaatgaaacatgtgtaatactatgtgaatcgaatcctatagataaatggaagaaaaataaattgtaaagcgaaattaaatgtttaccgtatataaacatttacgtgtatagtaaggcacgtatttatcattctcgaaaaggaaaagaatagaagtcaatgggtgcaagtaatgagggtatttatgtcatttaggaaatggattaccccagctcacacggcaagtaagtcgataacgaacaaggctcgtgaccggaccatgactagagtcgatatccaaatccaacgaactgacatataaacgggttttgcgtgaaacaacgaataacacgttcacactaaacttatattttatttttaattgatgtatatggttttcactttttagcttatttaaaattcgctttcatagttttgtttttatgcatttacattgagtttttagagtatttttaccgtcttttgttcttcgtttcaaattagaatcttgtcagtaattgtgaaattagaatcttttcagtaattgaatgtgtgtgcagttgaaaacaaggttatcgatctctagtttgatttaacacaaaacatgagataatgctcaaaagattttgatccatcaatttgatatcctcttattgatcattctattctacaaaaaaagtagttttacttttgttaggacaagaagcacaaaagaccaaatttggttagataacacaaatgatggtttgagcggttcaacaacacaaatttggtacgtaactactctgtttgcttataacaacaatactcttaaatgtaaccaccaatatgctaaagatattgttccacttttcaacaaagtaataataatattgttcgaccaatatactagcactgcaaatgatcaggtgaaaataaataatttttcatctttttcattttaaatggtaaaaattagttgaataattttttgtctaaccaatgtaatggttcgagtacatatatatatgatatatgtaataaagaaacatagaacaatatgtttgtaattaaacttgtacatgtacatatatatatatatatacataatacataatcaaatttcatctcacgaaaaaggtggataatcacaatctcaaatattatgttaataagaattttcggaagatcaacatcaatgatccaattttctcaatcagacattattttcctaaatttgcatcaattttgttctagttgactaattgacccaacaaaaaaaaacaatattattcgattcaatagaagtgtatattctaataacattgttttctttttataataatgaaaacaaaacgactttgatcaaattgttatgctgtccactcacacacgcatcatcaataaataaagaaaaaaaaaactcaaacccggtcaaagatatcccaattgctcgttgaccatgataaggacatatccgtcattttaatcttcccacgcttttcctcaagggcttattcgtctttaaacaaaaaaatagacatccactgggcacgtatcttcttcttcttcctcgtctttaatcaaaaccaatttattactctgattgttatttcgcaattcggtataattcaaacgggagatttcgttttccgatcatcaccgatcaacttcttcgccggagaacaaataagtttcaaagcttcttttgacgattaaagtagaataaacagaaattgaatccatgaagaagataaagagaaacctcagagaagaagaagaaggtaattgataaatctaaaacactaattagactctataatatcggccattaatggaggaatcagtttctctctctctctctctgtttctctatgtgtatttattttggtgtgtaccgttgggaagcttgagagcttttaatagctcaaccaatttccaagtggtctctctctctcgaggtcttagggttttagctgttgacttgtcgcagcttcactggagaattgaatgaattttcttatggtttcaggaaggtgatga

SEQ ID NO: 135 - DNA, 3000 bp, Arabidopsis thaliana
gaggagagagtgagagttgagcgagagttgttcggccggagaatctcgggtttgattggaccggagaaaaccggaattcatagagaaagaatggaagagaaagagcaatggcgggtattaatggagaatgccggttttgaatcggttaagctgagtaattacgcagtgagccaagcgaagattctattgtggaattacaattacagcaatttgtattcaattgttgaatctaagcctggcttcatctctttggcctggaacgatttacctctcctcactctttcttcctggcgataaccaaaccaaaccgatccggtattcttagttttgttttgttttcaatgttatttttggttagacaaatattcaattgttaatatactccgtggtcagagtgttttgtttttcttttagttcgaacgttgaattaattcaggggtaggttttgaattctctgaaccttatgtgttttttggtaacatcatttggatttgtgaactaggtttaaaaactggtcttagtcttgttgttttctcattagataatttaaactggtttgcttctttatttttggttggataaagtgaccggttctggtcatctgtttgagatgtaattactatttcataaaattaggaagttgaaagccaaatatatttgtaactactcttttatttgtaattttgctcaaaaaagtgatgaaatgtagttttgatatatgaatatctaccattatacataagtatatctgaacatggtacaacttatgaaagctaaatgtcaatacttgcaaagatataacaaatacaagttacatgaataagagatgtgtgttgaatttataagtgtcattttcttttcactttaaaacaaacttcatcttcttttgtttcttatgtgtcaaagttgccacagttgctctatttgagtctttcagtgtcagtctcagtcactgtactgattttacttttttttgttgagtgtgccaatgatgacatcactcccacgtcctccatccgtcttcttttaacggtcacgtggctcccaccctcttttctcgatgtctttaccgacttgttctagcccaacttacttgggccatttagattttttggtggcccaagttgctaaaagaggatttatcatagaaatctgaacccgttgcagcgctcaacacatgtcacagtcctgacaaacacgtattcaaatccttgttaagtcccgccacctgtcaccagagcaccacgaggcaaactctgatcaggacaccgtcgtactattatgtcggaagacaggaaagcttaattaagcttaaacctgacgtatttaacttcgttaactctaccttactaaagggttttaatttaaaacttatcatctcctcgtaagaataaaaactacttactctataaatttaagcttcaagaaacctccaaaagcagagaaatgatcaacgcttttaagactatccgatcactgccctcgaataccaccgtctcgttctgctcaacaccatctcgattaggccggaaagtcactggagttagttttgccaccacttctgatcagcaaaagatggataaaaagcctgaaaatccaaacgagaaaaccgggttcgtctcctccccatatgtgtgtagttgtttctgattcgtaatttggatgttattcaaaaaaaatttcgttctcttctttactttgatggagcagtgacgtgatgtcgcattcttatggagaagggtacgcaacaaggtctgacgaagaagggtttggaggaatctatggaggaaatcaaacacttcagaaggaaaacgagatccatgagaatcaccctggtactcagaatagttagttatcatatacacgtttattactacttatatgatcacttttattgtttacgattctgggtgtgtgtgtgtgtgttttcatgttattgaagattacgacaaaacgcaaggtagcgaatcgaaggagaaggagaaagcaaggaaccagacacaatcccactgctaaagaaaaaatgatgatttagtgtctttgttctttatgctttaataaaatcagacttgtgctctgtagttcgtagactctggttagagttttttttttgttaattgcgttttttgacccgtaacctttaccgggtttttgttggttatccttatcacttttgtaacactcgttgaattagtagtttttgttgattgttgaacattcccttaatttgactgtgtttgtttatttatgaacaaatctacggttttttagttgaaccgtcgaggaaaacattcttagataacgtcagcaatgaatattagcctgttttcggactttcgattccgatgcaacacgttaaaagtaacgtcagcgaagataaatttggtaaattcatctgaaactccaatgctgatggaacttagctggtgtgttgcgtgttcataatttatgttattagtaacgtcttagaagttggaatattcactccaagttcgcacttcaaaactttcaacaagtttttagttcttatcgtacgtctcaaaacagagttgaggagatttagcttctactgtttagtgttctacacttgcttcgtacaaagaattgaatttttatttccatagttacatgcacatatttgtattaacaatctcttattattggttagtatcatatctgtagttattcgaacactgggggcaaatttcatttaatcaatcacctaacgaggctatgatgcatgattaacgaacgttaaagccaaaatgtcaagactacccccttattatcagctcgcagttggtcaatgcctcaatggtctgaagttcagactctgaactataatacaaggtcaactcaacccgctggtagtaacgaaagtacgaaacagtcaaaaacatatcttaaaaattacataaaaaccggaaacgaagttgcagaatttacagtttctgccattgggacaatcattcgatctcatcattatccttctttctctcc

SEQ ID NO: 136 - DNA, 3000 bp, Arabidopsis thaliana
agcaaggatctaatggacacaaggcaattttctgcagcaggagaacttctttccattcgtcttgcacgttctgagctaggtatgacttacaatataattcaaggaccttttgtatcttttgtaattatatcttccacttctttgatattgatgttttcgatagaagcatgacttattgttcaattcttatcctaaattcctcagatgtaaataagcgcaagatgaccattgttgctagtacagtgagcctgaccctattcgtgatctttggatttgctgcatttggtttctggagatgcagagtggaacataatggtaacacattgatgactttactatcgaacaatctctcactgttcatctaatcatttggttgtcaataaaattgctctgttacatttgttataagatatcgttaaataaaaaggtgttttttccactactaaattgactgacttgtatattatttttctggtacattggtttcggcctgttttaaaaactctgaatatactcacttggcactgacacacatattctaacccatattttagctcatatatcaaacgatgcatggaggaattttctgcaatcacaagacgtcccaggtttagaattttttgagatgaatgccatacaaactgccaccaataatttcagtctatcaaacaaactcggtcctggtggatttggttctgtttacaaggcgagaaacgttttatcctctttgctctttttcttttctgtcatttcttgacatgacatttgcaacttgtttcagggaaaactgcaagatggaagagaaattgcggtaaaacgtctttctagcagctctgggcagggcaaacaggagttcatgaatgaaatagtactgatatcaaaactccaacacagaaacttagtccgggttttgggatgctgcgtcgaaggaacagagaagctattgatttatgggttcttgaaaaacaaaagcctggatacttttgtctttggtgggtcacttcttacccctttcgtgtagttttcccctttatatctggaatttcttatctgatagcttgtatacttagatgcaagaaaaaagctcgaacttgattggccaaagagatttgagatcattgaaggtattgcacgtggacttctctatctccaccgtgactcacgcctcagagtaattcaccgagacctgaaggtcagcaacattcttctggatgagaaaatgaacccgaaaatatcagattttggtttggctcggatgtttcagggaacccaatatcaggaaaaaactcgcagggttgtcggaactctgtaagaaccatcccttgataacatattaaactagattggtagtcatatattaaattgggtgaaactatttgatctttgaacagaggatatatgtctcctgagtatgcatggactggcgtattctctgagaaatccgatatctacagtttcggagttctgttgttagaaatcatcagcggaaagaagatctcaagtttcagctatggcgaggagggaaaagcacttcttgcatatgttagtaagactttatgttttcatgcatttgcagaggttgcaaaaggtttgttgctttgatattcttaagagtggaaactgaaaaacaggcatgggaatgttggtgtgaaacccgagaagttaattttttggaccaagctcttgctgattctagtcacccatctgaagttggaaggtgtgtacagattggtttgctctgtgttcaacacgagcctgcagacagaccaaacacacttgagttgctgtctatgcttaccacaacatcagatcttcctctgcccaaaaaacccacatttgtagtgcacactagaaaagacgaatcaccgtcaaatgattcgatgatcactgtcaatgagatgacagagtctgtgatccaaggacgttgaaactgtagaattggaattattctctataaggatcaaaatttctaatggttgtaaaattacatcccttcctttattattcagaaactttttatctatgtggaaactgtttggtaaaattgactaaggtatattttattaggcatgattacatgattccacttcccactaaattgacaaaatactttgctcaaaaacaaatcgttgactctacttcattttaagacttcccgggagattattctcgggcctagtggcacaccaatgttgactgttgaattcttcggttcttttggacagaaacagttaagcccatatggttggagttgggaatcagtcgattagggtcattacgggtctaacgacattagcgaggctcggaggttttttttatgcactgcaagtgttcgaggaaatgtctaaacgagataaaacatagcctgcatttcaagaaagttattgtgttgtaatggtgaagcaaggattggattctttcgattgatgcagaactaataaggacttgaacaatgacaacgttgcgtatctgattgggtaaggacttcttcgtgccaatctatcatgtatgcattgtttctattattgatgcagagctaataaggacttggaattgtctcccactcattcacgttgttatttgtttagtgagcagttactttctgaacaccttttttgtgtatttaagtaaatgattgtctttgaatggaatagaagaaaatttgcagtaacttattctaaagtctttgataaccaaagtcttcttctttttgttcttgatagcattgaacaatgacaacgttgcgtatctgattgggtaaggacttattcgtgctttgacacttttgttctctattatcaaataacgcatgatttttggaacattagtaaagattattaaataacgcatgatttttgttctgtattattctcacaagtcagtccctgagttgacaaaacaaaaaatgtgcaaagagagtttttttttttttttttcttgctttctcgctttatgtaaagctaatctaaaaaagatagtttttggagagaaataacaaat

SEQ ID NO: 137 - DNA, 3000 bp, Arabidopsis thaliana
tgtttgattgttcacgaaaggaatcagttttcgaatgtatataacttaacctttcatgctttttgtaaaagatttttcacttaagtaaatagagaaaattactatagatgagcttccaatttggttgaccaatgatttactatagagtttgcatttccagttgttctccagcagaattgtctaatcttgtgaggagcttatctgcagagccaaatgagctcataattttgggtttccattggttagatactatcatatcctcatagtataaaagtagaattagtcaatgccttaaatctaaataagggagccatgattgaatttgcacgtattaaaagtgaagaagaaactcaagtccacaggagaaaagtgtgacactccaaccaaaacaactcataattggtactaacaaaatatttcacatagattccaaattttgattagtgtatagcgaaaaaggaaaaaactgggcttgttacatatcttcagctcaattcggaggaaactgatagatagtaattccaagacaaagatgttacatgagaggcttttgagtagattctaactttagattcattaaagtatttactaaagagcaatagtcataatattgagagaattgttttgatggacaataaaagctgaaagttaaatcctaagcatataaagaaagaatttgcatactagcaacaagacatgctaaacattgagggatcacaatacgtagttccttccttggaccggtatcgggatgtaacatctagtcatcataagctgttgctgatgctgctgctgctctagttgatattgctgatcatcagctcttcttccagtactctcctttctactattgaccaaatcgaaaatcaacttagtgaagacacgagccgtcaattcgctgtctgatccagcgtgatgagcttttccaacacgcctcatctgcaacacatccgctattctctgtagtccgaaacggctacttagtccgctgcataatccagccattttcttcacatcataaacaaaccttcccaaaagctgctggacggtttcatcaaactctttcgaagtctcgggtaatggttttctagttaaacctttaagtagataagctttgtcgtaagagccttgaaaagtcacccatctcatttttccatgtttctcattgagaatctgagaaaactccatgaagaactcttcgattccaataccttcttctctgatcttatccagatccaaaccattgttttttaaaaacgctatagatttatcatttttcaagctcttagattcgttgaaatctgacaagttgatctcccaggttttagtgattcctttgccgaatagcgttaaccctaactggatgagatgggtgttgtccacattgaatttcatgtctctataacgaatttcatcacttgcgtccatgggagtctcctttaagcatccgggaaactctgtgtcgatagcgatggaattacaatgtttcaaacaatctcttatcgaattcatctctgcttgcttgttccatctccaaacttcaccgctcatctcgaacgaaactaagaaactgtttgtttatctgaaagagaaagtgagataacaaatgaattttatttggttggcgttatattattagagaatttatagggattagattaagacaccgacttcagtttccttatttttaggatactataaagttttcattttttttccatcaaaagttcgtgttgacttttttgactcctaattcttgttaaacacgagttttcaatttttctcttaaaattcaaaaacaaaaaaacgcgtggttccgaagcggttttcaatttttaacactaaaccgaattaaattccttgcccgaaccgaattaaattctaatttctctctcaaaactcaaaagccttgtttccgaagcggtttacgatttcaacgctaaaccgaattaaattcctattacaaattaaagtctaattttccatcccgaaatacacgaaattgacaaaagactttattttaagtcttcccggaaggttcttctctgggttagtggcttgacgacacaagtcaagcaacctgtcatacactgacacaagtcaatcttgactgttgaattattcggctgcttttggatagtgacagttaagcccatatggttggagtacgaatcaatcgattggggtcattaaggtcttcaagacatcaccgaagctctgactttttgttatgcactgcaagtgttcgaggaaatgcctaaacgagataattcatagtctgcagttcaagaaaaatataggttcttctgggcctaacaagctagtaaggactggaacaatgaaaacgttgcgtatctgatacggtaatgacttcttcgtgccaatgtatctatcatgtatttattaaataatgcatatttttggaaaataagtaaagtagttctgacaagacacagtgttttttttttccccggctctcttgcttcatacacactaatccaaaaaagatagttattggagaaagaaaaaaacaaacaaacggggacgatgaggatcacgttctttgcttctttgctcttatttaccaataccatctttataagttttagctttgcaattgcagggataaacaaagagagtcctttgtcaataggacaaactctcagctcctctaatggagtttatgaattgggtttcttcagttttaataactcggaaaatcattatcttggaatctggttcaagggaatcattccccgggtggttgtgtgggtggccaatagagaaaatcctgttacagattccacagcaaatctcgctatcagcagcaacgcaagtcttctgttatataatggaaaacatggcgttgcatggtccagtggtgaaactcttgcttctaacgggtctcgtgcagagctttcagacaccggaaatcttattgtcatagacaatttttcgggaagaactctttggcaaagctttgaccatcttggtgatact

SEQ ID NO: 138 - DNA, 3000 bp, Arabidopsis thaliana
agatcttcttcaatctcaaaacatcttcagatagatctttgatccgatcgtaactacaagacttggaacaacacattaggtgtttcttgtcgatacctgaactgcatagcaccattagagcagatgaaaatacactttggacaacagaattataaatttaaggatactgattttttgggtgatatgttgtggcttgtattgaatagtggttacgatctttatgataggatgtgaagaatgatttgtttaattgcatataaaagtttaagtatcattcttgttacaacttgcttatcctgcaatgtgatgcatatattttaattacccgtatatcatattattagtagatattttctcttataaagcaatttaaaactagaaatcatttgagatatacaattaatggctatccattgaatttaggggcaatgtgtatgttggcatataaaaaatattgccgttttgtttatacgttacacaaattgttttaattggccagtgagtagattgtctatatcatatgacatataatctactgtaacacagcaatatattaaatgggatgattaaacactgaacaggtaagatcaatacataaagaaaaatttagcagattggatctacaaaccaaattcgcatctgatttgttaagaaacaaatgataatctactgtaattgtttatagtaatcttaatatatgtgattcaataagtgagttttaataatattttttaaaacatcttgcaacatggagaatatttgaacattgaaattttcgtgatttcatgctgtttttttttgaccttttagatataaacatacaaaaataatcaaatctcatatatactcatatagttttggaatgccagtacgggttgacatttggaccctgaatggatgctgatttttgattcagtttttgagtttagattttagtttatagattttagattttagttttaaatttttgttattatatatttttgtttaaaaaatcccaaaaatttgttttttggtttttgagaaaaataacgctgattaataagtaaaaagtagattttctaaattttaacaaaagtaaaaaactaaaatcatgaatgaaaaactacaataaaatagttttactaaattgtaggaaaaccaaaatttttactaaattgtagaaaaaccaaaattttaaaatcttaattattatgaaaataaatttttaaaaaacaaaaaccaaaaactcaaacaaaatctacaaaacattcgaggccttggtttctaaaaaacattttgtaatgaaaatcaccaaacaagtcatcatagcccatatttagagcctggctaggttttgactgtgatgctcattattggcccatcatcacattggttttcactaattccatcgccgatgaagttgtgatctttcccgatcaccggatatctgtaaaagttgctgaggtaaaaggaaagtttttttgaaggtcgcatagtatccatttagaggatcggcgatagtaaaagacagtaaccaaaacccttaatatctattacatcgattcgcgttgaaaagcaatgacgaagctatctgatcttcccggagatttgctggaggagattctttctagggttccggtgacatcatcgagagcattgcgatctacttgcagaaagtggaacactttatctaaaaatgagagctttactaagaatcgcattactcaagtatattcatcagcagttagaagagaagggtgatcttcaggcgattgtcttgttaaagtatagtctttattcgatgagcgtcaatatccatggacttcataacgactttgctccatctataacgtctagaggtaatcgattttacggcagagagaattggaccgcgtctgcctctgccttttgagtcttaattgtgaagatactgtgactctatctagtgttagagaagagcagcttgaggtgttgtttcagaactgtcatactcttgagatggagatttgggttacgaccaacattgagcccaatgcaatgtcctggagcaagttcttatagttgtttttgatgaagacaaaaatgtatcaaaaaccaatcgcaacacagcttacttcattggtgtgaatggtaacttcagagaagtggatctcggagaaattacaacagtcagagtgatttttccgcatgccttctgttatgttccaagttctatgcttacttgttttcctaatcggttccaggactcatctcctttggcaccagctatgcttgaagagtttccggtgagatatacagttttctcgattcttttctattcagttatgttacaaactaaagtctgattcttgtattctttcctaccattaaaccaataaaattgtctccttaccaataattggttattattttgtgctcccacagtgttttcctattcgatcaatacaagagcgtttggattattggtttggcttttatttctttctacaaaatgattctgatttaattatattaatatctggggatttatgaatctggtggaagactttttgtctacatgaaaaagaaaaaaaacaaatctgtttctcctcctttgttgggagcaatttgctttctgtttcttaggtaagtcccttttaaatcctacttgggtgttatattctcccaacagaaataagttgttcgataaaaataaaaaccaagttgctgcagtgcaatggttttgctcgagaacatggcgtctggttctgttatgtgtcttgttttgggtaattttggcatgaaagagtcaactttcagtttgtggtcattgtcagcatcactttcttggtaaatttttgtgtaacagctgtagctcggaaacttcaacggacaagacttcaaatttgtcccccagcgttgttgacttggacttctgagttagacttgaccataacgagatatgtcttcttgaaaaacacttttgagaggtatataattccaaattatcatcttccaagtttcagaaaatctgaaatt

SEQ ID NO: 139 - DNA, 3000 bp, Arabidopsis thaliana
gaatgtacggttaagttagacgatttagttaggtacactattccggtttggttaaagatattttggagaaacattgatttgtgcggttgtacagttaaaaggggggcttactaacattgaaaaacaatttgccatcaatatttaatgcccaaaaagtttagacgtgactcttgtcacaattaatgcaaaatcattattactttggattaatatttgagataataattgttgaattaaagatgaacccagaaacaaaatttattttacgaaggaatgtgatgctgaagaagggttgatcttgtttatttacgaagtttggagccaagacaagcattatcgtgtaactaatgaaggttttaagaagttttttgttataacacactatgatcttcattgtattcgaaatcaactttgttttttatagaaaaacccagaaatcttttatttcctattttgttggttgaaaatgctaaatgagtagatatttatgtttataagtgtgtatatcgaaattctatttgtttttgtagatataatcatgttttcagttgcatttaatgggtttctcctgaatttatgatgcagttgggtaatggatattcccgtatttactatggtcggtgagtggagatgcaaagaagaagaatggaaatttgaaccagaggaagacatgtttggtcgatgtgtacgtgttaaggaaaatatgacgtacactaagcgaggctttcagtttgaagtccgcagagatcaatcccataattagttactggatgccgggagagatgtcagtgatgatagatactaaacgccctcctgtctacattgacagtcaagtggggttagatacgttctttttgattcgtggtgggtatctttttcttaacttgtttgtctctttcattacaaccgtcaagacactcggaaataatgtctctaggactcatggtgacgatgctgaaagtgaccatgtgtgtgatagtgtttcaaatgttgatgaaaataatgaggcgctagatgagcaagacgacgttgaagacggtaaaacagatgaagatgaataggagggggacaacgaaaatggtgatgggtatgatgattatcagggtgactatggatctatgggagaagtaccctcgatcctactatcgatggtagtgaaagtagtggcgaagattatgattacaacaagtggaacgatgtaattgtagaagaatatggaatagggaatgttgaggaggacttcattttcactcaactgactgttcaacgtccaggggaattcagtcggctgttggcagcgtgtacgtacacaagtcagcgtgtacctaacaaagataacatttctcactcgggtgaccgtacaccagctgtgactccaagaagtacgtgtcaacatggtttgtaccaatgtacgtacactatagattgaggagtatttttaagaacagaaaagtcatacaacaaacaatgtcttatctcgcaatcaaacaatgtttttgctataagcaacctaggtcatgtcctacaagattggagatagtatgcgttgatgatacctgtccatgacatttgactgctcaagtcgtcaggaattcagaatgtttcaaaatcacatcgtatgaaagtcttagaatatatctcagtcattgtcaatatcggtttattattgaatcaataaatttttcttaataatttaattcacaaacaaagatgtacgtatattactacacatgtacatacattaatttaccaacaaaaatgtacgtacattattgcacatatacgtacataatttttcaatatgaggaacaaatattatttcaccatatatttttatttaattattatgtatgtatggagattattgagatataagaatatgtaataaaatagcttaagttattagaaatcgtaccatatacgttccactaaataagttcgtgtacgtacattgtaaattgaatatacgtacacaaaagaaattcgatgaaggttataactgtaatttttcagtcatcttcaacctctgtatccttttttgcaaacctaattttgcggccgtctttaccagttttttcaaaatctcattttttttttcattttgaatactttttacaaataaatcttgtaaacctagagtatttttagttttaaaagctaaagtgtttgaatttttggttttttttgtattttgttcatctctgaaaacatgaaatttgtttctcaattttaaagttcaataggatgcctcaaatcaattacccaacaatttgaacggtaatgtcgaaaaatgaaggagtggatgaatgaatttcgaaattatttctacttttctctcggatctctccgtctctttctcgttttcttcgtttcagttttttttttttttttcgcaaaaccaaactgcaaaaaaaactaaaccaaaaccaactgcaactgtgcgattggttgattctattaagggtatttcagtcacaaaatgtttcaaaagggaaaacgtgaaaaccaactctcatttatccaaacgatgagagcaaaaaaaatttcatccacttttgtgaaaatttcttaatttttaataagtcatgaaagttgaaaccatttttggtcacctaatttgactttcacttgtcctttgatccttgacagtatatgaaacccgtactaggccttgactcgtttcatattcattcccttgtagtttccaaactatttggaagcggaaacgacgtcgctctttccagtgttactatcgaagacatttacatgccacttaaggcataatgacaacgaagtgttcgacgtatcgtttacgtaagcgcaatttagggaagaaaagtctttttgccttgctccttacgtcaccctaaaagtcaagtgttcgtgatagaaaagtctcttcgtatttgatccacaattctccaagagaataaatacaaatcaaaatctgtttatttaaagccaaacaataggttttaataaggaaacgttaatagataa

SEQ ID NO: 140 - DNA, 3000 bp, Arabidopsis thaliana
gctcagtttataaggtatgtttctttgagaaaacttcttaacggtaactttggtttcccttggttagatttataagctaaggatgatgcatttcttagggtgtgttctcgggtgggcaagaaatcgcggtgaaaagattatcgtgtacttcaggacaaggagacagtgaattcaagaacgaaattttacttcttgcaaagcttcaacataggaacttggttaggctattaggtttttgcatagaaggacaagaacgaatccttgtctatgagttcatcaagaacgctagtcttgacaatttcatcttcggtaattgttttccgccgttttctccatatgatgatcctaccgttctgttttttctgctctgtgttgatctttacgctgttacagatcttaaaaagcgtcaacttttggattggggagtgcgatacaaaatgataggtggagttgctagaggacttctttatcttcatgaagactctcgttaccggataattcaccgtgatcttaaagctagcaacattcttttggaccaagaaatgaatccgaaaatcgcagattttggattagctaaactctatgacacagaccaaacttcgacacatcgatttacaagcaaaattgcaggaacttagtaagttacttcatcttactaactcattaaccaagaaacaccggtataaacccgttattcatcttgtagcgggtatatggctccagaatacgctatttacggtcaattctcggtgaaaacagacgttttcagcttcggtgtattagtcatagagatcattacgggtaagggaaacaataatggtcgatcaaatgatgacgaagaggcagaaaatctccttagttgggtaagtacacaaaaccaaccaggtaattgaggtttgagtttgattcatcatgttaactgaatttgtaattctgtttgtttctcaggtgtggagatgttggagagaagacattatactaagcgttattgatccgagtctaaccacgggatcaagaagcgagatcttgagatgcatacacattggtcttttatgtgttcaagaaagtccagcgagtagaccaactatggattcggttgctctaatgctcaatagctattcctatactctcccaacgccttcaaggcccgcctttgcgttagagagtgtcatgccttcgatgaatgtttcttcttccacagaaccgttattaatgtccttgaatgatgtcactgtttctgagttatctcctcgttaggaagcttaatctgcatatctttttagtttcttcaatgatggattttgtttgtgtgattttttagacagcttggcttcatctagcttttgaaacgagtagaagttatagctttttcttttagttctacacattcgtcgttaatggtagatttgttttgcaaattcgattttactgtgttttaaaacatataacatgaaatttaacttaagaaaatgaaaatagtattagacttttactaagaaaagctttctactttatcctacacatgaaatgcatacacattggtcttttcaaaagcaacaaatcaatgttaaatacagttttctttatcttaactcctaataatgtagctatagaattcatgactaagcattgtggacccttggagcatttttagatggagatgggtgtttgtttctttattaggttttgttgcctagtagccacattctctcagttaaactaatacatttgtaaattttcacttgtaatcaactaatccaccaaatgaatcaataatgtaaactccagaatcgatctggcattgtatgagtatcaatatatgctttagtgccacttgctagtgcaatccacttgaggtttggctgcatcgatattagatataaatacttaagcgtcatgcaaaaaaaagattactaaataattgtagggttattatgggattttaggcgagcaaacaacatttaaactttgaaggaatacaatttgaaatatcaagatacgtaaaatatgtcacgtgcaataaaataaagagaagacccatccaaatcaagtgtgcgatactttgaccatatgagtcaatgtggcggccaaaggcaacaagcatatctaatctaagtattatataactaagcaaatattccactaaactagtatacaaagccaactgctccactaattgcctgacatacttatttattttcaaatttggtaaccacacctatagcttatacattttcttcgatggccttatacaataggaatatactattaccttctcattgttcttattatcatcaaccatttgataaatcctcatcactcttaaacattgactatgaactaaggacgtcagaagtagtccatacaagatatgaatggttggatcgtcctaagtcattgtattaatatacgtttctaatcaatggaaactatataattgtaatataatttttactaaatcatgtaacttgaaaacctaactttctttcttaataaaaattgaaccgctaaagtatctaatccatcatgtgtcaactgacaccgtccaaaatcctcttagagatgtaagaaaaagtttcaaaacaattaggtcagccaccaatcacatatttctatgcaggttgtataatcttgaaaaagaacaaaaaaagtagatgacaaaaaagaattaaaagacaataataataataccttataaagatgataataattcaaacagtttgacctttttatttcaattctctggtccaactttccaacctgacgagacaaaaatatagaaacttctcaacagcaataaaacagcaacctttcctttttgtatcccttctcctttgtcacctctcctcttacttttttatcaataggaagtttccgccattgtgacagacacagttcctctgtttctcttctttcatctttaagcaaacctcaaaaaccaatcctttattacgaagatcctcacttgtgtcttcttctccaacactaaaccccaagaaa

SEQ ID NO: 141 - DNA, 3000 bp, Arabidopsis thaliana
tgaaactcaaatcaacgaagtcgaaaaaaacaccatgtcttctctgatctcttttatcttccttttccttttctcattcctcactagcttcaaagcttccgctcaagatcctttttacttaaatcattattgtccaaatacgacaacttactcaagattcagcacttactccaccaatctcagaacccttttgtcctcttttgcttcccgcaacgcctcttactccaccggattccagaacgtcacggtgggacaaacccccgacctggtcaccggacttttcctctgccgcggagacctctcgccggaagtttgcagtaactgcgttgccttctccgttgacgaagcgttaactaggtgtccaagtcagagagaagctgtgttctattacgaggagtgtatactcagatactctgacaagaatattctatcgacggccattacaaacgaaggagaatttatcttgagtaacaccaacactatttctcctaatcaaagtcaaataaaccagtttatagttttggtgcaatctaatatgaaccaagctgccatggaagcagccaacagttctagaaaattctctacgataaagaccgaattgaccgaactccagactttgtacgggcttgttcaatgcactcctgatcttacaagtcaagactgtttgagatgtctgacaagatccatcaatagaatgccactttctagaattggagcaagacagttttggccaagttgtaattcaaggtacgagctttactcgttctacaacgaaactaccattggaacaccatctccaccaccaccaccgtcgccaagcagagcaaattgatgtgctgctttttacgtcgaagttttggccaagttgtaattcgttttgctctgctttacaaattgacgtgttgctttttctctgcgtttaaaattggtatcatcgaaataaagtaactcagtttcttacaatcaaagagataaggattgtgaagcagctaatgagtcttcttattttgtctttacttcagtcttctcgtctttgatagtgaattgctcatctagctttcttaatcttagacttggtcaatgttttggcttttctcatactaaaccaattaatacataaaatatttaatttattttctattacaattatctagatatttttagctacacgtgattgaaacgtgtctcaagctacaccaacgctcttcctcacaaactgaattcgtcgtcgatagtggttgctcttgctatcttgatgtttacttcgtctgatcgttgaactggcccgctgcaacattctgagtgttccaagtgattattctagttgtgcgtaacaccgtaacagtaaaaatgagctaaggaaagcgagatgcaagggagaaccaacagaagcataagtttttcctctgttattactaatggaaaaaaactttctttttcattttctaattccttgtcagatttctcagcttctcttctttttgttttgtgtaagacttggtcggagtcttagattacgctgatgattaaaaactactaaaaaagaaaaaaaaaagaatattacgcaaatgttctcgatgcattgaccaagtcctcttctggttctggctccattttcacatgcaggcccataaccaattttaacgagatttgttgcatgaaaagccgattgtttttccttggcagtaacgaaaaaaaattagttactttttaaaaactagggttttgaataatatcattaaaatcaaatagaacgaactagggttttggcatcatacaccgcctcattcaattattaacaaagctgagtcttcttcacggagaaatcacggctgagctaggtctcatataccttgcatcaatatcttgggcctttactaggatcggagatacatcaaacataaaatacttctcggttttattttctctttccttatgtatatgtgaatgcctttaaaaattttgattgccttttttctcgttttggaatagtcatgagaagctgagaaccaaaaaggaaatatttctcacctttgcaactagctagatggagcttatggatgcaaaattcgttttaaaacacattgtattcggatgatgtcaaaatatttcacattcatatagcaaattcatgtttatatattccgatattaactttaaatattaaaacttatatgctgtagattcatatccgggtgaaaacacgaaaggacttatgatggaaccattatatggaacgacgtcatgtggaatatcaagttatttaacttctcgcgagtaagactataaaaagtaatagaataattagtaactaacaatatcagataacgataggcagatgatttggtaatactattttagtatcactacatcacaataaccatactagcatatacgatatacaaattaataaattatcgtgcttaaaacaaaaacctattatcaaccaataatttcttcgcatcagtggcgacaattttttcagccccagaatgattctttgaagaatagtcaacaaagattcctaatttcaacaattctgttcaaggaaaagtacgaaacaaattctactgctagctagtttctctcatgtatatctaaattctattactagtaattaagatctttgaaatcatgccaactgctacatttattttctcttgaaaatcccaactaccttttttttgatcaaaaaaaaaaaagactttagagttcaaagcttgaatttagagttattatgttttaaattttgacagttttgataattttcttcattttaaaatgattttatattttccgtaatttttttctatatttcatatattaaaaaaataagtaatggattagtagctaaacacaagaagttggacaagacccgacaatttaatacgagacgcgttgaccttgaccttgacttttcgtcagcacaaaacgttatctacggtagtcactgagagagaacaaacaatcaaatttgtttcatatatcactcaaagcttg

SEQ ID NO: 142 - DNA, 3000 bp, Arabidopsis thaliana
aaattttgcaaagactaacaagctaggtcaaggtggatttggagaagtttacaaggtatagatatagtctttagttctctagctacctggttcattacagagttagggtaaattgatcatatcatcatccgtttttagggcacgttagttaatggaacagaagttgcagtgaagaggctatcgaaaacatccgaacaaggtgcacaagagttcaagaacgaggttgttcttgtcgccaaacttcagcataggaatcttgttaagcttcttgggtactgtctggaaccagaggagaaaatacttgtttacgagtttgtccccaacaagagcctagactacttcctttttggtatgtggcattaccatatacatattaacctgagattctgagtagacatatatgattgtaatctctaagtggctcatgactacttgtgtacgtgcagatcctacaaagcaagggcagttagactggacaaaacgatacaacattatcggaggaatcactcgaggaattctatatcttcatcaagattcacgactaacaatcatacaccgtgatctcaaagccagcaacattcttctagatgccgatatgatcccgaaaatcgctgattttggaatggcgaggatatctggaatagaccaaagtgtagctaacacaaaaaggatagctggaactttgtaaaatactaaccttatgaacagaagttttcaagaatattttcttggacattctaatttaatctttcttgtgtgttttatcttgtagcggttacatgcctccagaatacgtgatccatggccagttctcgatgaaatctgatgtctatagcttcggtgttttgattcttgagattatatgtggcaagaagaatagaagcttttaccaagcagatactaaagctgaaaatttggtcacctatgtgagtaccaaagaagaaacttagtgcatgatccaatctaactttgtttgttagttattgattaatgattacattgttgtacaggtttggaggttgtggacaaacggatcaccattagagctcgtggatctaaccatatcagagaattgtcaaacagaagaagttataagatgcatccacatcgcactcctatgtgttcaagaagatcctaaagatcgtcccaacttgtcaacaatcatgatgatgctcactaacagttccctcattttatctgttcctcaaccacctggattctttgttccgcaaaacaaagaacgtgatagctttttgtcgagccaatttacaatgggatgtacttctcagactaaaaatgatgtaaccattacaaatctagatcctcgttgaagttgctgttccaattgacaaattggaattgttactgaaaacaacgcagattccacatgtgaggtattatttcacttgaaaatgaaatgtgatgatccatagttatgtaagatttgtgagtcactcaaagttatttttcatacaaactctttatcatttctacattgtaacattggtttgttgtattgaagatttctgatacgaatggcttcaaaattttataaacataccaattcatgtatagtagtaacgcaaatgttgttatgcatgtaaaaaagctctgtaaattagacggattcggtttggctttaccggtagacgaatttctacgaatatttacccaaaccggtttatttactaaacctataccatatgaaccggaaaccaaacgctattaccgacttttcttcttcactctcttcgtcggaatcagcctttgcgcattcttctgagctcggatttagggtttagcattctggttctaatggcgtttaatgatattgattatcggatttgtttgtgctcttttgttagattttgatgtgtttaatggcataatcacgatttagctaagggctccgggccaactgcgttttccggtgggaaatgtaatccgtctccgatgcttatttggggtaagagagcaaacatgggataatactgcatcaatttgatagacctctatcactaatctgttgtgtccttatttataagctttggtaaatatgtgtgttcatgatttgatgattaaattatgtacagccagctttggaggtcgagccagtctgcaaacaggcccacttcccaaactatcaatgatgtaaccattacagatctggaacctcgttgaagataattgaaacagtcagaagccatgtttaggtgttttatctgtttgtagactggctcgaagttataaacaaactctatcaatgtctacactgtaatatcagccctttgttatgaaatattttgcattctatttggactcaattgttgctgttgttactcacactagtggttcgttgctactctgtttcagccaattacgacatgttcttctggtttcggcgtgattcatatgtacgcattcttacatgactcaacccaagagacactgattaggctataaattgagacgaacagaacacaacgaaaaaaggtatgctaatcttctgtttttttcttttaggcttttacaatgctttgattgccaaatgtatatgtatagtctgggaatgtgctgagcagcctatgacaaaagccggtttatttgtgaaattaatgacactgacactttagcccaatacttttcttgttcctctccatctgcctctgcgtcactgggtttgattctatgaatactttatcctttatgtcattatctgagtcaacattccaatcaatattcaacaacccccttattatataatgtgaacaaagaaaatattattgacttttagcttttgacattgactttgacttttgacactcgttttcgtgaccatatttgtaggtttcaggaccactgtcatcaatttgacgaattcaatatttgaaaattttggagagaagcttcgattttgcttgtttaaactggtaagaaacgtacagatgcgtcaaacactaaacacaaagatctagcttttgctttaatcttcaagaaaca

SEQ ID NO: 143 - DNA, 3000 bp, Arabidopsis thaliana
tggattccaaagcgccagggcgggacaagcccctgatagagtcaccggacttttcctttgccgcggagacgtctcaccggcagtttgtcgtaactgcgtcgccttctccatcaacgacacactcgttcagtgtccgagtgagagaaaatccgtgttttattatgatgagtgtatgctcagatactctgaccagaatattctctcgacccttgcatacgatggagcatggatcaggatgaacggaaatatttcaattgatcaaaatcaaatgaaccggttcaaagattttgtgtcgtctacgatgaatcaagctgccgtcaaagcggcgagcagtcctagaaagttctatacggtaaaggccacttggacagcactccagacgttgtacggcctggttcagtgcactcctgatcttacaagacaagactgcttcagctgtctggaaagttccatcaaattaatgcctctttacaaaactggaggaagaactctttactctagttgtaattcaaggtacgagcttttcgcgttctacaacgaaactactgttagaacacaacaagcaccaccaccgctacctccttcgtctactcctctggtgacatctccttcactaccaggttaatttctccttcctctgtttcttaccctgatttcttgaaattagtcctttcaatttattttaggtttgttctgccactatcaaatcttaagccaatgatctttgaaatgcagggaaaagttggaattcaaatgtgttagtggttgcaattgttctgaccatccttgtggctgctctacttttgatagctggttattgttttgcaaaaagggttaagaattcttctgataatgcaccagcctttgatggtaacattcaaatgattaacaatctcaattgggtttgactataatcttgtttgctatttttctgatcacagagacttttattgtgcaacaggagatgatataacaaccgagtcgctgcaacttgattatagaatgattcgagctgcaacaaataagttttcagaaaataataagataggtcaaggtggatttggtgaggtttacaaggtactattactacgaaattctcttaactttgtacgtttaattgaaatgttgtgtcaactcaacacatttggataacgagatgatgttgatgaaaacgaatagggtacattttcgaatggaactgaagtagcggttaagagactgtcaaaatcttcaggacaaggtgacacagagttcaagaacgaggttgttgttgttgcaaagcttcagcatagaaatctggttaggcttctaggattttctataggaggaggagaaaggatattggtctacgagtatatgcccaacaaaagccttgattactttctctttggtcagttgcattttttgctttatttcaatgattctgtagctattcgtgaaacttgggggactaagcaatatctcacacagatcctgcgaagcaaaatcagctggactggactcgacgatacaaggtcattggagggattgctcgaggaattttatatcttcatcaagattcaaggctcacaatcatacaccgtgacctcaaagcaagtaacattctcctggatgcggatatgaatcccaaacttgctgattttggactggcaaggatctttggaatggaccaaacccaggaaaacacaagcagaatagttggtaccttgtaagtcgtcttccaattgcatttaacttcttagaagttgaagtttgttaaacatcattttgtcaacatactaaagttttttggtggatttcagcggttacatggctcctgaatatgcaatacatggccagttctcggtgaaatctgatgtgtatagcttcggagtgttggtgcttgagattataagcggtaagaagaacaacagcttttacgagacagacggcgcacatgacttggtcacacatgtaagtttaaaggccattaaggattatatttacctcgttaacaataagaaatgtttgcaagaactgatttattgattaatattctaggcttggaggctttggagtaatggaacagcattagacctcgtggatccaattattatagataattgccaaaagagtgaagtggttcgatgcatccatatatgtcttttatgtgttcaagaagatcctgcagagcgtccgatcttgtcgaccattttcatgatgctcacaagtaatactgtgactttaccagtgcctctacaaccagggtttcccgttcagagttgaactgaaaaggacccacttcaaccaacgaccaccaagtctgttccaagatttattgacgatacatcaatcacactgatttatatcctctttgaacatggtggttaaccttcaagttaacaactttttcgctcttgaattgacctcaagagagatttacatattaatgtttgtattttaaagcaatatttacatagatttagtgatatgtgtgactcaaagtaacactatttcgactaatactaattttcagttgcatttgatgaacgttttttttggatgaaaatcggtttagtatcaaagttgtatatatatacaaaaaattgataagattgaaatatgccgttttcgacaaaatagggttagcattttggttttaatggcggtcatatttagattacttgattcgttttgcttctttagattgcttgatctttagtcaataacattaggtgttcatttgtacgcgtagactccagtgattgctgctttcgccactctgttcgggagacttggttgtatgaagatttcaaaagagaggagacttggtttaaaaatgccgaagagatattaatagtgaagcagctaataagactttgtttactttagcgtttacttttaggaccgtgtagactggttaaacgactactgttatccagtttgacgaattcaacacttggaactttcagagaaaaaacttcggttttctgtgtaaactgataagaaagggacagattg

SEQ ID NO: 144 - DNA, 3000 bp, Arabidopsis thaliana
ttcaagtcttaatatcgttttttaaaaaaatttgaaattacatttacaaatcgaaaagtgttaaaaaaaacttaaagataccaatttgacctaacttttttttttttttggacctaacttttaaattagagaattggagacaatgagaaatcgctgtcgaacatacattgtcgcaaaactccgccgtcattgttccccgaatccctgacagtgaacttcattgttcaagcgaggtgagtttcctatttttcttcttctcctttcaattaaaatttcagggtttatgatctctagggtttaggttttattttcttaaactaaaccctaaattctttttcttcttctttttcttgtaatttccagatgcactgcgaacgctagaggaggtgcgatatcgaagaggaagcgttatacaggatcatgggaccaaaatatatcgtatagattcggttcttgttcttctataccttatgagagtagaagtttttctcttcaagagaaaaaaaaaaaaaagaaaaaaaaaaaagaagagtagaaatttctctgtgtttttttttaccaacaagacacaaatgaaactggtccaaaaggagtgtgtataatctctgtggagacataactaatacgttgatgaatttcaagaatacttggattatatagattaaccctgactcccttagatagagatcgaaatcgggtggtgatttctgagaccatacaagttctgatcagattactactaagtaaatcttaattattagactgtttttaatggatttttctgctctaatgataacgtaatgagattttttttttttttttgtatgtttggcttgcagacccgggtaatgagaagtttggtaagagcaaaaggcactaatctcacgtaagaaaacacttttttcatcaaccatgtatataatcatgtcggtttacataaaccgtatcgtctattcaagaatttagttttgtataattataatatttttttcagactacttttcaattaagcatctttttcttggatttttttttcacaaagggagagctttaactttttgcattaacttatatattttaaattatacatgcatgcataccgacttatataaatcatatggtcaatatgagacttttgatttatattatttgtcaactaagcatcttttcagatgaggttcatgcacctttgttagaattatcggaccagaagatcacatcaacgtttaccaaatcaacaaaaaaatccaatccgtccaaaaaatttggaaactgtttgaaagattcgaaatgttggagcaaggatactcagttccaatctctgagcagaatctgatatgactcatctactcataagactttgcgagatagaccggtacaaaaccgtttccaagggttcataatatatggattaatgtgagttattgtggacgttgtggttgtagaagccgcggtagtcgtggaaacactaattagttatctcctgtaagctatttttattttttttcctcacttcctcttcctcgcagctatgtataattttggttggttatctccaaaactttttatggtcaaacaattttgagaaagtaatttggaaagaaaaaaggtttaagaatatctttttatcgtcaagtcctcctccaaattacttccttaaaactgtttgaccataaaaagtcatagcaaggtattagttattctaatttaaattaaacgcctttttatcaacaacaaaaaaaagaagaagatttgatatgttgaaaagtattagggacgcttattagggcagtattcctagttattgcattttctttcggtcattcgaccttaggatcatacctcaatctgtatgactgtattcgccatgtgaattccaatattacatagtgaccaaatttgatatccaactaaaagtcgatctttgatctaaacgaaatgacaactatttggttagtgattgcaggttggaaagatttaccttctagacctgtcttacgaagctagtattctaaagtaatcttcataaaccgaattcagaaacaaaaaaagaaaaggagtccaaaattgtatgatcatacattaatatcagaatagtctcttttgttaaataaatatctgaagaatatatatctctttgattattttgtggatggcaatgaaactaagaatatatattcattgacttagaagtcgacaaaaaaaaataaaaaaattattgacttaattactagttgaccaatatatatattattaaaagaacatattgtatcgttgaaagcggatcatcgggttttaaaagaaaaacacatcgttgaaacttgaaagtgatgactaataaaaagatctaaacgtgtccggtcacctaccaatgtggttttgcaaattattgtcaagtaccttgactatattaaataaaaaaattcaccgtaacacattgatattcaactgattcctaaaaaaatatacaaactattgggagttgtgagattttttatatcagtgttggtctctttacatttgtgatgtggtgttatagcatatatagtaataaactcaaaaggaaattagatgtgttttgaccatttattaaaatgaaccttttcttgtcaaacatttgaaaaatactagtttttttttttggcaacgttgtaaataatagttaaaaatagattttaagtctcgtttttttatgcatatagtttcattcgctttattagactcaaatatacttttaattaaattttgcagagaattaaaggtaatcatttgccaaggaaaaaccatgcaaatatgcaataagtagaaataatgttaatgagagtaagcgttgacatatattacgtcctggtccgaacattcttaaagttgcgtaacactaataaccttagaagatggttggttgactatcaacatcttattgaccaaatgtttttttttttttaattataaaacagttgctcattgctctagcccagagaaagcagctcaattaagtaa

SEQ ID NO: 145 - DNA, 3000 bp, Arabidopsis thaliana
aagtcgtcaaattctgtcgtcgaatttagtcaacgcttcattcacttcagaagcgtcataccaaaaagcaggggtctctcggattccgtacatgaaagctcgaatattccgatctgagttcacctacagtttcccagtcactcccggttcgatatttctccggttatacttttacccgactcagtacaaatccggttttgacgcggttaactccttcttctccgtcaaagtcaacggtttcactctcttgcgaaacttcaacgctgactcaacggtacaagcttcaataccgttgtcaaattctctaatcaaagagtttatcattccggttcaccagactctgaatctcaccttcactccctccaagaatttgttagctttcgttaacggaatcgaaatcgtctccatgcctgaccggttttactcaaagggaggatttgacaacgttttaagaaacgttagtagcgacgttgacttccagatagacaactcgacggctttcgagtccgttcaccggttaaacgtcggcggacaaatagtcaacgaggtcgacgattcaggaatgttccggcggtggctttctgatgattcttttggaaactctggatccattgtgaatgttccgggtgtaaagatcaactacacggagaagactccggcgtatgttgcgccgtatgatgtgtatgctactagtcgcttaatggggaactccagcaacttgatgttcaatctaacgggtatgttcctcacagttgatgctgggtataactaccttgtgaggctacatttctgtgagactcttccacaagttaccaaagcaggccaacgtgtcttctccatattcgtcgaagataagatggctaagaaagagacggacgtgattcggttgagcggtggtcctcggattccaatgtatttagatttcagtgtgtatgttggtttcgaaagtgggatgatacaacctgagctacgacttgacttggttcctctcaaggacactaatcaaacgtattacgacgctattctgagtggtgtggagattctcaagctgaatgattctgatggtaatcttgcaagaccaaatccagaacttctagtatctacggactcaacaccagatgattctaatgttacaccaccaataaaaggtaagccacatgttttggtgataatcctcatagtcgttggttctgtaattgggctagcgactttcattgttatcatcatgttgttgatccgtcagatgaagaggaagaagaataaaaaggagaatagtgtcattatgttcaagttactactgaaacagtacatttatgcagaattgaagaagattacaaagtcgttttcccacactgttgggaaaggagggtttggaactgtatatagaggaaacctttctaatggacgtacggttgcagtaaaggtcttgaaggatttgaagggaaacggtgacgatttcatcaacgaagtcaccagcatgagccaaacatctcatgtaaacattgtttctctgctaggtttttgctatgaagggtccaaaagagcgattatatcagagtttctggagcatgggtctttggatcagttcatctctagaaataaatcattgactccgaacgtgacaacactatatggaatcgcgctaggcatcgctcggggattggagtatttgcactatggctgcaaaacaagaattgtgcatttcgatattaaacctcaaaatattctgctcgatgacaatttttgtcctaaagtcgccgactttggccttgctaagctttgtgagaaaagagaaagcattttgtcattaatagacacaagaggaactataggttacattgcaccagaggtggtctcaagaatgtacggtggaatctcccataaatctgatgtgtatagctatggaatgttggtcctcgacatgataggagcaagaaataaagttgaaaccacaacttgcaatggtagtacagcctattttcctgattggatctataaagatcttgaaaatggagatcaaacgtggataattggagatgaaataaatgaagaggacaacaagattgtgaagaagatgatattggtgagtctttggtgtattcgaccatgcccatcagatcgtccaccgatgaacaaagttgtcgagatgatagagggcagtttggatgctcttgaactcccccctaagccttctaggcatatttccaccgagttagttcttgaatcttcttcgctttctgatggccaagaagctgaaaaacaaactcaaaccttagattctacaattatttagcgcaaaagtctatttttgtttttgatagtttgatcgaaagaattataaaaaaaatataagaaacattttgaaaacgttttttccgatccattaataataaatatgaaaaactatatcaaatcaataaagtcagaattctatagaacacattaaaatagaatggtgataatgtaatctccaaaaatatgattgcatcattccctccaacggcacaaagattcaataataaattatgaagtttctctacaaggagtcttgctgaaacattacacttatgcagaattgaagaaaattacaaagtcatttaaccatgcctatcagatcgtccaccgatgaacagagtcgtcaagatgattgaaggaagtgtcgatgctccttcaatcgtgagaattatacgtttcaacattaaacttataaaattttgttaaaataaaaacagagtatgattggtacgttggagctggagacttttcaatattcatcttagcattgtgccaaaaaaaataagatcaaagtcatatccagaaatttcaaccactcacgcttcatacctagactattgaaaatcagcatttattgcatcagacaagaatgaataattcgattctaataactcgtcaagaagatggttcgtatgagatagtttgagctgatagaaacatctcttatcttcttcttccttcattaaccttttaaaaaaaattccg

SEQ ID NO: 146 - DNA, 3000 bp, Arabidopsis thaliana
gagttgggatctgtgtaaataatgacattaatcaataaattaataagataataatttttttgaaagtcctatgtaaatctatggtctcatcaatatcataaattaataattatataaatatatcaactatatatatatattatatgtaaaaaaattctttataatatatttataattttttttgcttaaattcatatttgttttttgtttgactatagttttcatattttactgtatcaaaactattggtgttgttttctagacattattattatgttttacttgtaactggttctagaaagatataatctataatgaaggaaatcttattgaaatttttaaaaagttaccaaattagtaaaatctctctataaattgataaatattatttattgataaattaatacctctctaaaataataaaattttgtagtcccaacattattaatttatagaggttttactgtatactctatgttccttattatttgattttctataaaaataattgcttttaaaaaattgatttttttaggttttttatgcaatattaattggttgtaattgatgaatatgaaacttcaagataaataattaaatatcattggtttagaattataaaaatatgtaaatcaaaaaaatattacatttataatcagtttttaatacgttttattaatatgtgtattttttctagaaaatcaagaattaagaaacaaagagagtaataaactataggtgaactacttcaaaattgcaaagtaacatacttttactcatgaaaaaactactcttgttttttcttttgttactataattaaaaaaatcacactatagtttttatgatggatgagaagaaaatagtccaaaccacaaagtgtttaccactatattattttttcttgtttttctttaatcttcataattgctccacttttactagaattaaaaaaaaaactaactaagattaaaaacataatcaaataagttcttcaacatttcaacacttttatttaatattttaaatttttatatacttgtatattttaccaaaaaaatttcatatttttttcatacttaattcatcaagtgatatagaaacaaaattaaacgtcaaatttgagttaatttaaaaattctacttttggtaaatacaaataattttactttgcaatgttaaagtataataattttgttttaagtaaataagtggcaaaacaaattttgtaaatgaagaatctatttctttactcaaatccatactattgatttagaaataaaagcaattcatacaactgaatagaaattatgtcatcaaaaattattttgtccttacaaaacaggaatataatactagtattttataaatttacattagtaagcaccacttttcttcctcgaactcaataatccaaatgagacactttcaaaacttcatctattcctttgtaaattaacttttaacactgtttctaaacttgcgtgtcatcttctcgatattgtcaagaaaagttatcatgttagattcactatacccaaaaagtttccattattcttctaagaaaatcatctcttcaatatttttttcttcctctttcatgggtatcaatagtttcatttctacatagttttactcctatctttatcttgtcagtcatgattaaaatataataaaaataaatttcatgttggtttttgtcgaaaatagtatttatccaagcattatcgccatcacttgtcaacataaattttttacatggatcgttaatttataaaataaataaaaaaaaatataataatctcttgttaaaaaattagacatcacgtttcttagttttctctattgctcatttttgatctattacatggatgataatcaacatttagtctaacaagaggatcttattcattgccatttattcctaatttaccatcaattacaattctattaccaccaatcatctatccagaaatcgaaacattcgtataaaaataactaaaaaaccttaaaaatctaatatttaaaacaaaacaaatgtcaattgagaaaactccaaaacggatgggaaaacagattttaataacaaacaattccattttaatacaactaaaaccatattatatacactacaatcttatctcattctttattatgaaaacctgttttaaaacaaaataaatataatacacaattttacccaactaaaaaacaatatttgaacataatatgacattttcaactttatactataatattcttttacttcaaaaaacaaaaacattacatctgtaatgtaacacagattataatctagtttatgtgtaaaattttaaatataactaaaaacaattaaaaaaataataatattaaatgtatatatagagtagaacatatattcacattctaaaattataattcttctgtttcatattagttgtagtttaagatttttacacacatattaagaaattataaaactatcatttaatctacatcttttatataaaaacattatttattataatcaattcaaccaataaaaaaatatataattaaaatagaattaattagaaaatattaaatatatttatttatttgtatagaaagttaaaaacaatagaaatagagggagtagtatttatgattcgctccgtttttatcgaataattagtattgctatttagaattaggattatctagatttttcaaactgaaatggataaaagaattcaagtacaatctgattattattttcaaatcccagatgcactctttcgacaattaagtttttttttattattattgtgtaaaatctaaaattaagttaaacgaagattttttaaaattctctcgtagttcataatggagacgctcatttaaaattgtcaactttgacgactaattacaatatctaagagtaattaattaaagagaaaaagagtcttcattgataacagaagagagagagaagaagaagaagaagcttcacaatcgtaaca

SEQ ID NO: 147 - DNA, 3000 bp, Arabidopsis thaliana
tttatagatcatttttgcttgagaattgaagttttcattttgaaacaactctacttaagtatcttattaatgaatacgtaagaacttacaacttcaatgtttcaaaatagatttaaatatataaggaatagataatgtttttgtataattcagataagttctcgaaggaatatatatatatcaagatgtatttgaaaaaaaaaattattaaaaagtcccacatatatgtatatatatatatatagatatactgaaaatcattgagacaaaaaacattcaaaatcagtagagcttataggttataagtaaaatgacttatattattataaagaaaaagacttatagaacaaggtgagaacgtagttacatgtagtatatatatagacaatggacatacaaataaatgtgtaaatattgtgtaatgtacttataaatattggaagatgcatgtttgaggaagttgcacttaaggtttagggacgttcgtagtgagactgagacctcttgcgctgtcactgtttaggccacgacgaatcagtctgatccgttactattgccttgctgtttactaatattctttattatttataattatttaattgtttttttttaatcgtttaatgctttcacagttttattttaattataatatggaatacacttggcgattcgccaactaattcctgaataatttataattgaagatttgaatgggcgtagatgattgcgggtcattaataccaagttaactcccaactacatttttttacatttgaacaatcaatatcaattattttaaattaaactatataagcatacccctccaaataagaacctatttatgatttattgtataaaaacacaacaatatctttaagaaacagttttttttttttttgttgtcaaagtagaacatgtagttttgtactctttgttgcatataataataaaccataatatagtttgagggaagagctgaaagctaaagatgaaatgtagtttagattagtaatgatctttaagaaatagttaatgtttgaaggaaagagctgaatcttataagaaattagcatatatcatttctagattcttattctataatctatattgtatttttgtgacaaaataaaataaaacactaccagtacaatatacttgaataccggtatctatatgtataaaacacggaaaaacaagacgtaaagtggtttagcacatttgtgttaataacgttggccgttgaaaaagtttcgatctctcctaagaagatttacacataaaagtcaaaccaaacccacacgtcggtcgtgaaaaagcagtaatttggtccatttcatcaaccaggggtacttttgggatttgagtattatctccgggaaagaaagtacacgggggatacgtccaagtgccagctggcatccgtacttcgtcttcccaaaataccttaacaatcaaacacctctttctttcacacttccccacgttcctttttttttattaatatattttctccttaatctctattttcaagtgccctaatctttatagtatttgtaatctgattatttttttcgccaattaacgtgggaaagtaagttttgttttggtttataacggggaaatgtaaggttaggtattattatgttgacaaaaatttaaaggtaggaactattttccttttcttacggcaaaggtggaagaaactaaagaattagaggaagcagttctgtattgaatcatcaaccgtcaaagtagacacaataccaaaccaaatatattttcacgtttgcttatccatctttgaattccacctgaatcaaaaagaaagaaagaagagttctctaaatttcgacatttcatgataagataaacacaaatttaagaaaaaaaatagttggatgcttcaattggtattcctctaacgggcccttcatttaaagcacactagataacagagtaatagttttccttttccacatgtttcatttattaccatctatataaattatattttcaggtggaaaataaatccactatctctctaccctattttagattcaactaatggcttttactagtaatgataactcaatcggtcattttggttgcacaatatctaacaccaaccaacccatattctgatttcattagacactagataacaatttttgtttagttttcaaccattacccatatttaagaatacaagaaaaatattaactaatcttaaattaatttgtttgccttaataaattattatgcacatatttgtatgatctcaacattttatgcaatctgcaatattgatcaatttagtagatcggtcgtcttcgtctttttttctttgaaaagtcaaaagtcaaaagggtttggaaaatttaagaacatgtttggttgaaaagagaaaagactcaagtggtcggatctgtccaaaagttttgtgacggtcacaagagggaaagataaaaaggaaacggatttgaaggaaacggctcagagagatttaagacactcgcagcatctctctacttctctctctctctgtttcaacccctcttgtcgtctatctccatcaaaaagaccaaaatcaaacatcattgaatgttagacagagaggcaaaaactaatcaaagtgtttctaatccctgaaaataagcccacttcttctattttcctcatttcagtttctgggttttaatcgatctccccctttctcacccttccgtctgaattccggtctgcaatcgtcggaaagttttggactttacaccaacgccaaagcgagttcttgtttctctgtttgcttctctaggaccaatcagtttccatttacagatgcgtactattcacctgtcagagctctgagatttgtctttttgcatctctctgaatatttctcttttctcagatccattgacctcatccacatacataaagtttaggtatttttaaaagggttcaattctggggtttaccggaatttcatcatctttgaagacc

SEQ ID NO: 148 - DNA, 3000 bp, Arabidopsis thaliana
atcaatgtcattagaaaatacttacacaaatacatgtttattgacttagcttagcttccttcatagattttcatcaagttagagatatgtacctataagtcggtatcatagatctcgtatacgctatatttaattgtacttactaatgtcaaatgttaaccaattgtttacaataagaatcttagattaagctcattcttaatttatagtgtatgaatttcaactacgaatgtagttcagaattctttctttatgagtttaggtttctatattaaatatagatatgaagacttaaaaccattttagataatatatcaatctttagggcggggtcaatgatataaaatttcataataaaattacatatgttagatatcaaaacatatagttcttgatttgtactaatgttgacataaattgatatataaatgttaacgtgtcgcaattacattgaatttaccatgttttctaactaattaacctgcaatctcagtttataatgtatgttcacaatataaatatccgaacaacaacaaaaatgaaattaaaaagacttttcacgatagcaacatgccaacatctaataatggcgggaagcaacttacataactggtcagtttgtaatgtatataaatgttgacggcactcgcttagttaacttgtgaaatggttaacgagggaaaagtattataatcgttgcttagggaaaactatttagaacaattccgcattagtcttttggacttatccaacaaataattgatattgacaaattaacattataatctccattagcttattttaaccctacggttggcttctaagaacaactctaatttgaacatttctttgagtgacttttcagtgtcggcgtttcacatggatgtctttatctgcaacctcaaagaaaaagtttcgattataattgttagaagtttttattatactctgaactttttttgtaacttttagatataaaaaaaacatatatatggggcttatcttatacattactaactaaatgcatctgggcctgggcctgattctgggcttagccataactggattattttcctttttttttttttttctgaaatcaatgatatatccatcaaccaaaagaaaaacattcagaaatttctttcaaaatctcttaagctagttttcttgtggtccagaaaaaaaattggtttctttttactgaaatttaaaccttgagaagttttgaatcaacaaaatatggattttgaccagttgccatactataggcttttcttttctgtatgctttccgaattgttcatagtattagtctataatacttcttattggaaaatatgtcgagattttgaactaaaaattgaccgatcaagatcgttaccaaagatattacttttacagtacttgtattttattaacttagccaacttcaatatctatataagaatatgatcttgtcattttattctgagaatctaataccaaaaagaagttatatggcgttcttttatgtttctaaaccctatcatatcaatttaacacatccgaatccaactataaccagtcctcctaaatgttagagtgtcgggatagaataaaattgaagtgcaagaaaattcaaagaagatcgatcatgaagctgactgagacgaaaaatcaaaggtcaaaaattgagaagcttcctaaagagacaagtggacaagttttgaccagttgtccatttgacacatgaggacccatcactatcatatcactccttaaagtcgttgctctctccctcttatcactacctttctttctcacaaatccaggattcattcattcacgttttcctacacctcaaacaagttttcaacgtcactatagactatagtgtatttatggaacatttcatttcctaaaaatgatacaatctattatcaaaagagaaaaaatctaacaatttttggataagtccacttattcataagtactgtgacatgaaatcctattatttatctcagcatttagtttgtttctgcatcacgccaaaggagaaaatgtcaaaagaatcttccgtttattgcatcacaaaatttataaaaattcatatgcagaggaatattttatatgtcgaccactgaatactttctgatgaaggaacaatattagttacataaccactaatataacacatagtaaatcttagcctctcatttgtttgttgtcgtcaatctcagcctttcaagccacactatctaaaatgatttttgcttttgtacttcctgtgaaacgtttggataagtacacatctattctgatatctttttagtgttcacacaatattaagttttggaaatgttgcaagaataatacttctgtcaccatccagaacgttttagtcaattagagaaatgatagttctcttacaagttaaatttagttatatgaagtttaaccaaaaaagttttgttgaccaaaaaagaaagctttaccatggttcaaaagttctggaaataaaaccaaacaaagccgaagagaaacacgtttctagaactccagtctcagaatcacaaacttgaatttgtgtgtcttaaccatatgactcataagattgaatttacttcatttaatttaactaaacaaaaatgatcaacaacatctcactcattgaccattgaccactagaagtcacatgcagacaaactggattaatgcatcagtcaaaatcaaagtgtggtttttttttgtatatacacttcctccttataaaaccaattaatcatagaatgaaattaacttctatttaattcaagcttatataatcttgattaatacttcaccaaccactgacatattattcaaatctcacaaagcgtggcctcaaagaaacactaccacgacttttttttcttatccttctcttcacctcttttaataacttcaatttctatcttcaatcttttcctctttcgtttaacaaaacagagtaaaactaaaccggattaaaccggaagcagcc

SEQ ID NO: 149 - DNA, 3000 bp, Arabidopsis thaliana
agtatgtgttatgatcagtttacctaattgggttagaaagatggagttcgatttaagatatcttaaaagttcaaaaaaaaactttcctttttcatgaaaagctcaacaacttcaaaatctttgttttctggctgtttcctcttgtcttcgattgttcttgttctttggatttttttgttttaactttttttttgtctgaaactgctgtttcaatttggaatatgttgcaggagtttttgaggttgaagctgttcctccttggtaaaacagagcaattatgctaacttgcgccgtcttttcaaatcttgaccatcatcaaaatcatcagtaagctataaccatctgtttataaccatttgcttgaatcaagaaaaaaagtttatcttctgtttcttgttatgaacagttgaaaggaatgttcaagaaatggggaagaaaggaagttggttttctgcaatcaaaagggtgttcacaccacattccaaagagaagcagctaagcaacaacaacgtaagaaattcttttaaacactttcattttgttttataaactgaaatgataaattttgagattgaagtgtatatacattttggtgtttggttttgtgttttgaaagcaagaaccagagataaagagtgaaaacaaagaaaagaagaagaaaggttttggaaagaaactaaggaatggagaaaccaattcatttcttcccatttttagacagcctagtagtatcgaaaagatcttgtctgaagccgaacgagagcataaccttgtctttaggccaccaactcccactgatcgagcaaattcatcatcaacctctgttgcatctcctcttgttaggcctgcttctcctaaagtgccttctcaaagatatgtctcttctccaaaacccatttccccaagagttgcttaccctcaagtccattatccgaagcccccttctccaaagccgccttctccaagagcggtttcgcctaggattgtgcagcgacgtgagtttgtgcatagaccagagccaagtctattggtcaaaaatgcttatgcaattaagattcaagcagcttttagaggttacatggtaataatgtaaaacattcttgattctgttttgtcactattaatcaagcagtaaaattcataatttaggagatggaaatttgtttgcaggcaaggaggagtttcagagctttgaaaggtctagtcaggcttcaaggagtggtaagaggacacagcgtgaagcgtcaaacgatgaatgctatgaagtatatgcagcttttagtccgagtccaaacacaagtccagtcacgtcgcatccaaatgctcgaaaaccgagctaggaacgataaagatgacacgaaattagtctctagtcgtatggtaagtgctctcataaaacttagtgagaaaagaagatctctctcagttattcattttgacattaattattgttactttcctgcagtctgacgattgggacgatagcgtgctgacaaaagaagaaaaagatgtgaggcttcataggaagattgatgcaatgatcaaaagagaacggtccatggcctatgcttattctcaccaggtatgcaatcatgactcatctattcttcttcttactcaccataccaatgttatatatgcttgtttcctatgcagttatggaaaaacagtccaaagtctgctcaggacattagaacaagtgggttcccactttggtggaactgggtggaccggcagaagaatcaaaaccaaccgttcaggctaacaccaacacgaccgagcctgagccctcagcctcaatctagcaaccaaaaccatttcaggctcaacaacagtttcgacacgtcaacacccaattcatcaaaatccacattcgttactccatctagacccattcatactccgcaaccatacagtagcagcgtctcaagatactcacgaggaggaggacgagctacacaagattctccttttaaagatgatgatagcctcacaagctgtcctccattctcagctccaagctacatggctccaacagtctcagctaaagcaaaactaagagcaaacagcaatccaaaggagagaatggaccgtacaccggtcagcacaaacgagaagagacgaagttcgttccctcttggttcgttcaaatggaacaaagggtcattgttcatgagcaacaacagtaacaacaagggtccaggttcttcttcttctggtgctgtggtgcttgagaagcacaaaaccctcaaatccgttggaaatttgagtattgattctactgtttcgatgcctgcaacaattgggaggagggcttttaacagatttgcgtgatttgtttttcttctttttttctgtgaaaaaatctgacctttttttcccagttgattcttcattgatttgtttatcttacatcaattttatgagtgctgatgattttgagtgttgtttgtgttcttgattacgaattttacagatgtaacataataagaaaaagtaaacaacaaaaacagaggatttggattgtacagtatgatgttctgtttttctgcttgtaaatcccttatctgtcttttggcccaagtaacaaactttaaccttttcttttgggccagacttcaactataatacgttttgtaggctatattttttcttttaactagattcgaattggatggcttgggtatgcggtatcagtgattacttagctaaattcaaatcatcaagaaatgttcacatgatttcctgcaacatgtcaaaagtcagatcaacttagtttgataagttatgttccacgaaattatgtgaaaattgatttgttttcttctttagtttggtgctttcacactgttaatccacaaagccttgttgtaaatcttgaccaatggcctaaaagtcaaacctttgacttttcagtgtttcttctcaacactcaagagatggatgataatattcacagatgatcaaaatctttcacacaaacctaaaaaacacccacca

SEQ ID NO: 150 - DNA, 3000 bp, Arabidopsis thaliana
ttccgtatattatatatcatctatttaaaactactttatctaataagtagcaatctgcataatacaaatgatcataaaacaaatataattaattttgtactgaaataataaatatcaaataaacttgtaagacatagggcatagccattagttacttaagtacctcattaaaatttttgttctaaaatgtccgatttattatatttttaagtcaaaaacatgaataactatatatataacgcatgtaatataaatttaaaactaaaatacatctcgtgcaccgcgcgagcctacttcaagtaaattatctaatatattagtaagaggtaagtggatattacttttaatgtgtgaaaaattcttaaacaacacttcaaatgaaataaagatagtgtatgttactccaccattgaaatcaaaattcaagaaaggataacaaaaatggtaggaccatattccagcaatccacaagtgacaagtgcttctgctggttatgttttacccaattttgtggatttcatcaattgattggatgataatggaagaatatgcatagtcttttctcagtactactttaaacccacctatctaggttaggcccgtctagataggcgggtttaaaaaatatttataaatttttatcgatgatatttgaattttaaatagtaaatgataattatttttaaatatttaatttagtaaatttgttttaaattaaattttaatcttacaataatcttacattgcagaaaattgtaatattgaaattcgatttaaaacaaatttactaaattaaatatttaaaagtagggattatcatttactatttagaattcaaatttttggttaatgggatctcaccgctatagattcaaatatttttataaatttgttttgattagaaccttggctataataaaacaataataaaatattaaatatagatgataatatagaagaaaaacatatgaaatcgtaatatttttaaaaaaaacagatgacttaaataacgtaagtagatcaaaggaaattgatgcatttgatgctcctgatataaattttttggaccgttctttcaggtttgtttaatgaattgatccatatatttgtgaacataaatgttggcatggatcaagcggcgatcttgcgaaatttgacatcgaaaatttcgtataaacgtatcaagaaatttactcttgttaataagatattagttttagttaaatataactaattgtggtaataatctaatagttgaataaattatcatcaaattgagagattaaggtttgaccgtttgagttctcttttatatgataaaaaaatatctaacattctatatatctcaaagattgattgggttgggattatatccggttatattaaaaatattatcaacagtgattggtctgtaaaccaggattaacttcagtttttttatatacaaacaaaggccaagtcaacgaacgtactaaattaataattatgttttcttttggtattgacgactttgcataaacaaatagaggtaggaagaaaattcggcagacgatatgttatggtgactttcatgtcgatttcgagtttgtgaaaatataatgtttaaaattgggtccacccacactattcaaaggtggttttcatgttttgctatgatccttgacatttataaaaattctaacgtatctcgatataaatagctgccatattttgatttttctattagtcaaactcacatttgatccttatctaaaatttccaacataactcgagattagtccaactgactcaagccaaaggtttgaattctttgtacttagttcagattcattcagcactaatttcactatctttgatgagtattggtctagtttacttgcttcatttgagtttccaaaatctttgactacttctcatactagtttcattcatcttttcgtactaatctgtaactttcaaatgatgtccaatttggaagaaggaaaaaaaagcttgagtccttaaaatttctaaattaagattccgaatggagacgtgcggttcaactgcggataaagtgcggtgcggttcaaatagtaacaaattatatacatatatatatgcaaagaatttcgttattatttaaaacacactgcactgcggttcggtcaccattcgaaacctaagatccaaaattatttcaaaaatatcgcatactaaaaaaatgtggaaaataatcagcataaagtcgcagggattagcgattaaaaaccaaccttcatctctttttaatcttttcttcatctctttcattttctgtcgataccactttttttggtgattccgtaaacagtgcaaataacatcgataaccttggaaactcttttataatatagcgacaatcaatggtgtatagatcttcaatctaaatacactacacacatcacaattgatatttttttagcaagaaactctcaaatcttccctctgtattaaactttactagtttgacaacgagaccaaagaatacatattacaaatccaaatccaaaatgtcataaagttgactaaaaaatagtaattgtataataattaaatcaaacctttcatgaaagcttttaacaactgtcattatttctcaaagctttatcaacccccacttataataattaatttttaaaagattttcttaaataacttgtacaaatatagtatcaaattttaaacctatgttaagtactacaataacacgctttcctctgtattattaaatcattaatacgtatatgtgacgagaccaaaagtacaaaaagtccaaagtacaaaactctcaatccccaaaaagtctcaaactttgacaagaaaaaaacagtaaacagagaataaaatgaaaaaatcaaacctttgcatcaagcttgcaactttccttttcaacatctgtcttcattgcctcttaagccccaattatgacaacaaacctcacgcgtactgtcttcttcgtcttgttcttcttcatctacc

SEQ ID NO: 151 - DNA, 3000 bp, Arabidopsis thaliana
aaccagattgggatataaaccaagaatccccttgatctcacgagaggttccaaaactgtcagatattgtcgtagacgaaatgttcgtcggattcacagcagcgactgggagacacggacaatcgagtgctcattacgtcatgggttggagtttcgcaagcggtggagaacatccacttgcagctatgctcgacatctcccaacttcctcctccgcctccgaataaggcgaagaagagaggttacaatggtaaggtcatcgctcttatcgtggctttatcgactgttatatcgatcatgttggtgttgctgttcctcttcatgatgtacaaaaaacgaatgcagcaagaagagattctagaagattgggaaatcgatcatcctcacagatttcgatacagagacctctacaaggctactgagggattcaaggagaatagggttgtcggaaccggaggattcggaattgtttacagaggaaacatcagatcatcgtctgatcaaatcgcagtgaagaagataaccccaaatagcatgcaaggtgttcgagaatttgtcgcggagattgagagtttggggagattaaggcataagaatctggtgaacctccaaggatggtgtaaacacagaaacgatctcttgttgatctacgattatattcccaacggaagcttggactcgctgctttacagtaaaccgagaagaagcggagccgttttgtcgtggaacgcgcgttttcaaatcgctaaaggaatcgcgtctggtttgttgtatctccacgaagaatgggaacagatcgtgattcacagagacgtgaaacctagcaatgttctgattgactccgatatgaatcctagattgggagactttggactcgcgaggctttacgaacgcggatctcaatcgtgcaccaccgtagtcgtcggcacgattggatatatggcgccggagctagcccgcaacggaaactcctcatcagcttccgacgttttcgcgtttggcgttttgctgttagagatcgtctccgggaggaaaccgacggactctgggaccttctttatagccgactgggttatggagctacaagcgagcggtgagatcctcagtgcgatcgacccgagactcggatctggttacgacgaaggagaggcaaggctagctctcgccgtcggtttgctctgttgtcaccacaaaccggaatctcggccgctgatgagaatggtgctcaggtacctgaacagagacgaagatgttcctgagattcacgacaattggggatattcagattcttcaagaacagatttaggatcgaaactcgtcggatacatttcgtcggatagggcttcgagctcacactcacacacatcttcgtctctcaccagaatttcttcaacttctttaatcagtggtagataagattcgattgacacattcaaagctcgcattaactcttttttttctcactaaactataattcaagttttggaactgtgtttaaaaattgggctcggcccattgggttctttgtctcgtgtccaacaattagtttaaagcccagccatttgaaatcggaccggattgacaatcaacaactatgtaaaaacatggtttagttttaaaaatcggatagggttgagccacgtatttcaaatctcacgcgaccacatgacgtgatcttctatagttccaatactacatcattaaggatcatcatgggtaaataaatacgcaaaagagaaatattgaaactaggacaacatttacaaagtcatactgataaggatttagtatgtgtcatgtgacaattcgaatcaaggaatttgcagcacttatcagatcagatttcgtaataaatgcttatttaaatataataattatatgcggtagtaacaactaacaagagacccacatggcgtaaccataaaaggttgtttcttctggcaaatgtgaaaaagtgattaaagtaaacatatgatattactactaatcattggtagattaatcattattgtataaaggaaaaaaagttactgcagtcgtataagttcggaactcaatctaatcaccaatattatatattatattttagagtttaaatcacacaatgtccttgttcaaagtcaaattatttttgtttttgtccctacaaactataaaatatctgcatattcaaagaacgatgtggaatttgtcaaagacagactacatatatgcgtaggacttttgagaaaagaaaaaaaaaataaaaaaagttagtttccagcataaaagataacatgaaatttagatcattttttatattttgaaatttgtaaatatcttaatatggctttgcattttaaccccataaatatgtaaatttgttacatatttagtttgcatacttgtatttcaaagtcactagctaaataaaattaaaatgtaatttgttgttgaaaatcatcaatgatacatgtttcaagtaaaacaacaaaataataatcgattgaataacactagattagaaatcgattacaaagaaacagaaacagagatattattattcttttaaaaaaaaaaaatcgattagaaaaatcatcttaaacaaccaaatcattgatatcttataactaacagatgacaaatgatagtattttggtcctagccacaactttaaaatattgaaatttctttcttggttgacaatcaatatatatttgtcaattattttaactttttttcttccaaatattaaattgaccacaaagcattggagtttcatatatatatatttgttcaatactcgcgctaatgtgaaccagttttcaaaggggaagaacatacgcaatttctagtttaaaacttataaattcttctttcttcagtctccctccttataacaacttctctaatccttaaattattcttgttatcttttccaaaacgccttctctctgtttttcttttgtatgtttctaatgtaccgatcattaatgggtactgcaagatccataatctcattt

SEQ ID NO: 152 - DNA, 3000 bp, Arabidopsis thaliana
aaacccttttgctatatgctctttactctttaatcgttttttgaggttcatgtttctatgacgtattgttctatataagactgtttgggtaatctttgaatttgaagacacctcgggattaaagttttttttttttccaaaaggtgtctttgtatatataacatctaaacaacagcatcatccatcaatggagaatccatgttggagaggcaagtacaagatacaacaacaacatttacaaacaacgaaatacaagtaaagtacaacacattctgccacaaaagagaaagttgtcaaatggtagcttgttaagagcaacatcataactaatctcaataagaccaaacatcaaaactcaaaaggtttggagttgatcttatagcttccatcatatgcttgtagtatgattgctttgtgctcaccatcttaacatccgaacagggtgatatcttctactctgattataagaaaactaaacagataaaagcataaaactaaaacaatctagactagaagcttaaccatgattaaaaagccaaactaaaataaaaatcaaaagcgataagaaagagataaggatggcacaatcaaccaaggaaaaggtgagtcatcaaagtggccggagagataccggaccaacttctccggtaaactgaaaaagattacagaaccttcaaaaccaccatgcccaaactaattccaaggcagcaaaaacatccttaactgctaaaagaaacatcttcttctttattcaatatgtcacaaacgaagattgagatatggcttcaaaaaccttcgagaagaagcatcttacacaaaaaccggccatgacgtcgccgaatgagccaacacatgccggactcaaaccgtccatcgccataaaaaggaaacggtcgatgacgaaaatgatagccgacccaacacatcgaataataagccggtcgttgtcggactgaagccggttgcaacaactggacggccttgccggaattaaccggacggctttatcggaataatctgaacggcggaagaaatcaagtttttctctctagaagatttaagagagagaagagagaaaaactcatctccgttttccccgacgctcatgacttgggattaaagttagagcattgttttcgctatatttttcgtcgtttggttattggtttcggcttgctcatctttttatttcccttcaatgggattgatagcgaacaagtaaatatatttttgcattcctatataaacattcgtattaaacccattttatatagctcacccacccacttaccctttggcgaaatcaattctttgtttttttttgtctaactcaccgtctctgtctctgaattcccagctggagatatcagtcgccgtctttttgctcttggtgaagatagattcgagaatcccgaaggttctacgattaccacagagaaattcactatagtgagtaccccatctattggatttgcagcaatgcatacgtctcgcagtcaataagctgaggcggagtcacgtacatggactttttgcttgagctttctaccaaataacccacaggttcgtcatttcttagtatagtgtcatgttgaagaattttcggtcacatgaatgttcaagttaaatcgtatattgttctgtgatgagaaagattataatctgcttataaacactgttccttcatatacggttaataatctctaaacttttgttttaaaatgattatgttaaatcacatactcaacaacggaagatgaagaaatgtttggattcaactaagcattatattagttatgcgtaatctgtagctgtagagaacatgatcttattgaattttgtttcttttgttgatgttttaacttctaattaggaagattgtaatctggttatgatatttttccttaaattaagtgttttactcgtttcgagtttttgttttctgctgattatggccattacaagacgcaacaatggagaaagaaaaagtgtttggataatgatgttactgatatggtcactttattcacaatattcatagttttttttttttcttcttatagatttggttgcgggctcctcgctgcagaacaggacagaaagagactgatatgttaatgtgcaaactcgaatacaagcaaccgaagcaaataggagatgtgtttttcatccaatgaaaggtaaggctactgatgttattgagactgtgaaccttcaatttcttatatgacttgcaagttagattatgaaattctattagaataaatttggtgcatcctaggaatgttaggaatttgatatgaggatttaataataacatttatttgacatagccaacaaagattaggaaggatggtggaaatttccatgaagcgtgtggaaataaacattctgagttttttaagggtggtaggattgaaaatggtcattgttcaataaagttgaccttggcatactataataataatatacaaattgcattaagaaattatcaaccttatagtatcttatattatcttaatgtcaacgagtttttcgagccccataatttaatttatacagtcaaacgcaatagaagtgttatccgttaaacttgagtgtatgaccaaaattttttaagtcacatccaatctagtggctctgccaactagagacgtttttatccagagatttgtttagcaccgtcctcctttgccaatgatcagtgttttgacattttcctcttaaataatattaaagaccaatcagtccaaacttttttacctctttctttttctcatggaattgattttgctgtcttgatttagacaggtgttggaagtcttattaagggaaaagtaatataccataaagataccaaagcagtcgtaatatttgactttgaagtcgtattcaatgggtctacagccagagagaaagagataattgtgaagcattgagagcaaatagagtatacaaaaacaaaagcgaaacgataactctctatttgtttcattacca

SEQ ID NO: 153 - DNA, 3000 bp, Arabidopsis thaliana
tttagacaggtgttggaagtcttattaagggaaaagtaatataccataaagataccaaagcagtcgtaatatttgactttgaagtcgtattcaatgggtctacagccagagagaaagagataattgtgaagcattgagagcaaatagagtatacaaaaacaaaagcgaaacgataactctctatttgtttcattaccaatgattcgaggattgcttttgggaatcatctggatgatattttgtgtttgttcatcatttcagcaagagacgccgtttgtttacaacaactttggtcacgtagatcatcttcaccttgacggtagtgcaagaatcattcccagtggtggtatcctgcaactgacaaatgcaaccaatagccaaataggtcatgttttctacgagaagccgattgagttcaaatcatctgaatcagtctcgttctcgacatattttgtgtgtgcactgctccctgctggtgatccgagtggccatggcatgaccttttttgtgtctcattccactgatttcaaaggcgcagaagcaactcgatacttcgggattttcaacagaaatggttctacttccacacgtgtgttggctgtagagcttgacacttctctagcttcagatgtgaaagacatcagcgataatcatgttgggattgatgtgaacagcgcagagtctattacatctgccaatgcttcttatttttcagacaaagaagggaagaagattgacataaaactcttgagtggtgatcctatccaggtttgggtggactatgaaggaacaacgctcaacgtttcattggctcctcttagaaacaagaaaccaagccgacctcttttgtcatcaacatccatcaatctaactgatattttgcaaggtagaagaatgtttgttgggttttctggctcaaccggatcaagcatgagttaccagtacatactcgggtggagtttcagcaaaagcatggcgtctctgccgaacattgacatctcaaaacttcccaaagttcctcactctagcactaaaaagaagtctacatctcctgtgctcagtgttctgcttggtttaatagctttcatagttttggggattcttgttgtagcttatttgtataggagaaacttgtactctgaagtaagagaggaatgggaaaaagagtatggtccaattaggtattcctacaaatctctatacaaagcaaccaaaggattcaataggagtgaatttcttgggagaggaggttttggtgaagtctacaaaggaactctccctcggagcagagaactgagagaagtagcagtgaagcgagtatcacatgatggtgagcacggtatgaagcaatttgttgctgagatcgtgagcatgaggagtttaaaacaccggagcttggttccacttcttgggtattgcaggagaaaacatgagttattactggtgtctgagtacatgccaaatggtagtcttgaccattacttgtttaatcatgatagattgtctcttccctggtggagaagacttgcgatccttagggacatcgcatcagctcttagttacttacatacagaagctgaccaagttgttatacacagagacatcaaagctgcaaatgttatgttggatgcagagttcaatggaaggttgggagattttggtatgtccaggttatatgacagaggggctgatccaagcacaacagctgcagtgggaactgttggttacatggcacctgagcttacaacaatgggagcttctactggaactgatgtgtacgcgtttggtgttttcttgcttgaagtaacttgtgggaggagacctgtggaacccggcttacctgaagcaaaacgttttctgatcaaatgggttagtgaatgctggaaaaggtcttctttgattgatgctagagatccaaggttgacagaattctcatcccaggaagtcgagaaggttctgaaactcggtttgctatgtgcaaaccttgctccagattcaagaccggccatggaacaagtggtgcaatacttaaatggaaacctagctttacccgagttttggcccaattctccagggattggagttctgtctccaatggcgctttccccagcaccactcgtgatcccttcactatcattttcgtcttcctcctccaacaactctatgtttattactcactcagtcctctacgggagtgggcgatgaaagtttctaacaacttccctcttctttggcctcttaatattgactgattttcagccatttctattcagattttgtttcattaatgtatatggtagcaccatgtccattctccatgaagcttagcttgtagaacgatttttaaaaaactgatttttcaggtaaattcttgcaattacttagttcattatttgtaaagcaagttgttgtcaccatttgagtacagtgataaattgttatgtattgagaaagctgatatagttatggatttgtttcttttaatggttatgctattttggaaaactgatagatatcaaaagacacaacagtttagtctgtaactaaccttattcatgccagatctcaggtacctgcaatatattattgcaaatcacgtatcctaggagatgcatgtttctgcacatttgagtaggctcttggcttttaaagagttaaaatactcggagatagtgacaattcaacattttatttcgtttaagacaagtaggacttggtatgacaatcaatgagaagcttgcctttcaaaactgtgaaactacaaggaaattttattatgtggaacttctgaattcttttatcaaagaagactaaaatgtgacagctatcatattgttgaagtcaactcttaccaattctcttggaaaatgcagaatgttcttcttcttgtgaagtaataatccgaccttgtttcgcagatggagaggatagttatttgccataccattgactcagagacaggatttttctcagaacagcaaacactttgttgcattaaca

SEQ ID NO: 154 - DNA, 3000 bp, Arabidopsis thaliana
agctgctgaatcttggatgatgtagagtccatgagtgaagcaactgaccgagtatcctccatcacaaaagagcctaaataaaacggaaatttaagtaatgattaaaaagtcccgaacaaataaaaacaaacatgagtacaacgacattagaggccagacacaatattgttaccaattcaaacaagtccaatctccaagctgcgaatagagagctccacgaaatctcgatccttgaacaacaaacaactacaaaaaaaaaaatcatcaagaacagataaacaaagatcagtcaaaactatccaatgacaatatcactcgttaaagataaaaacaaattagctctgtaacaagaccgtacaagtcatagtggacaactatgtaagaaaatggcctacaaggcaagtaaagacaaatgaacaagaaacccccaaaaaaatgaatccattcaagaaaaattcacactattttttagtcacaaagataattcaacctcaagaactaatcagacgtacttataaaaaaattagctgaaataatacaaatacagattaagagaagagtagatgacgaaatgagagtagaaacaagcaagctgattcagtgattctatgaaatcccagcttaatccatcacataaacaaacttcacgaccaaaattcaaggtcatagcagaaattttgagctatattgtggagaaatcaacaaaccctagctacagtgaagagaacacgaacatgaactcaaaacaaaaaaaaagtatatacctcaagagaagataaaaaaaaagcaactttaccaggaaaatcaaacgaagtaaaaacccgtaagaagaagagatcaaaaaacttcaagaaggaccacatgatcgtagatccatggtgaagagcgatcgagagaaatcgaggttaggcagagagagagagagagagaagaggaaagtgaaatccctaaaaaggaaagaggaaagtagaagagaggcaaaataaaaggaagcaaagcgatttataacagacactttattaagcacacccaattttacttagttggcacgtgagagagactggtgtggtttaatggctcgttcttcactatcatatctggttcggaccagacagcttatgtggctctagtcaaaccctttaaagtttgcgtcacgtgagtttgtctgaaactgccgggaacttgtaatttactctttcctcctttttttctattaattggtatattcaccatctatgtgtatcaatcactctttaaattccttaactttttttaccaaacacccaatctttttaacctgttgacgaagctttggcttcatgcttaaggctatgttataatggggaaaaaactagattgcacaatctttcatagactgatattcttcatcggatgtttcgatcatataaattgtctccaaggatgaaactatgtgtctaatttttttgaatgcaaaatttatatatgattgttttcttaataagagcaacaatgaaaatatagtttggttatacattggtatttgtcaaagaggaaagactaaaccaagagtaaataaatcttacaacttcccaaattgttggaattctacaattgtattatatatggtgaatgatttggtacaaaacattacaaatatcaaatgaatttcgaagttggttcaggtcacgaatggcggatttggcttgggagagactagaggttgtgattcgtggtttatctcctctctaaaatcgttatgttacaaactgactatcaaggataatcatatcaatcaagataatgaagagaatcaatatcgtcaatcacgttaattgctcataatcattgtatacaatattaagtttccttcagtagctttctagtctttgtatataaacactctgtaatcatcttgtttcatatattcgatatactcttagtctacatggtattagagtctctgtatataaacactctgtaaaatttctaaaatcgttatgttacaaactgacaatacataaacaacacgaattaacattttggggtgtttgctgaaccgtggttggcgggtacatctgctaaatgaacaagctttttatatatatatatatatatataactgtcaacccataatttaaagattccaacaacaacaaaataagtactactcctaataagtatttaaatatgtgacatgatattcaatttttgtgatacaaattattatgcattggtatttgtcaaaaactaataccaagaaaacatttcttgtaaatgtcatattccattctttgatttggtcaaaacaccaaaaccatttacaaaatatccagaattatctaaaaacgaatgaaaagcgaaaaataccaaatggaagaaaaatttgtccatctcctaacaaacaagataatatatatgatgatgttgaaaagtcaaaaagagaagaaagaaaaaaaaaacatttaacgcgcaaagaccgatttggtttttgttgggagtcattgcgttctcatcatcagtgtctctcttttctttgccccattcttcacgaactttcactagacgacgacgacgatccaaagtcccagtcaactcactcacaaagacgactcctttattaaattattcccaactcctttcttcatcatcatcatcatcatcattcataaccacttagccacagatgcgattttcttctccttcttcattgtgctcttcaacacttatgaacaagagcaccaccaccacgacaacgacgactacaaagaccaaagctttcgttttgtgtttctgattttgattcgtaagttgttgtaaatttttctaagtcaacttcaattttaaagatcgctttagtctttttgattcgctggcgataatccaattttcgttgttgctaataaagttttgatttttttttatttgcttacaggattttgatgctcatcgaagagaacccttgattttgttgctgtagttcatagagattttacacattttgtggaatttagtggattt

SEQ ID NO: 155 - DNA, 3000 bp, Arabidopsis thaliana
ctgttgctgttccaggtagatcgctacttccggattctcacattggtcttctttaatctgtgattgtttcaatcgaaaagcctacccgagttttctttgtgttgctacagttcttcaaagaaggtagtagatgatgagatgactagagggaatgacgaacagagactgcaaaaagcagagtttaaaacatctcatcaatggttttgttgatttccttgttgctcttcttcttaactttagattagattcttacgcaactctgttttaatctttagctaaaggtaaaaaaaaatagattttacaaatgtaaaagtttcttgcctattgagagcagttacccaaaaaaaaaaaaaaaaaaaacaatatagtttttctgttatcatcatcaagtcaggtgaagtttgaaaatagtattagcattataaggtttaaataaagattaggtctgaagtcacaatattcacaaatcttatggtagatgaatatcaaacaaaattcaacatagatttacccattgattttatatttctttcattggccgtcgagagtttagatagaagtgttttattttatcaagtaaaattttatataagctattattagttatcaacttgatatgtcaaaaggagaaaggagttgctacactttaattatcggaaacaaaaggtttaataaagattaaaggtcacatgcatagtcatttatcttgtggtaaatatgtgtaaaaacaacatagatcatccattgaggttgatgtatatttgaatgcacgtcgacatcttagatatgtaagtgttttaacttctcaagtaaaaaaaagatttagctagaagtaatcaacttgatttgtcaaaaggagaaaggaataatcaatttgactttgttggctaatataaacaaaatatatgtaagaagtattaacactaaattgtcggcaaaacgtgaaaatgtgtgtaattcttcccatctcattactgttttaacagttttccctatagatctgatttctattattacggtattaatctatatatttacaaattcaatagaaaaataaaaaatattgacacttatcattttttttgccttgtcatttagaaggaattaataactagattttatatatgtgtaaaatgagctatgtatctttatataactccttgttttggaactttgtacatataattattttattgacaataacatgaaattagtgagtttcatcataggttataaacttataattaaatctttcaacggcattaacacaaatcatttatttttactaaatcacacattttcttattaatattgcaaactatatttctttctactactcctaaaggtccatgtttttgtcaagtgtttcaaaatgatcggaattctaaagaacggcatcattactatatttcaagatatttgacaatatattaatttacaattaaagtggtatataaattagcagattaacagaaaataatcaatgagatgtgtgagtctttattatacatttttcacatgttaattttttaagaataaacacttttaaacaataaaaataagttatgtttttgttatatattacaacttttcacaataaactgtatttttgtaacgttttattttctattcattcgtgcttccagataaacgtactgtactgtacgtcaatacaaaatcacgtttcttgtctaatattttgttatctttagtaaattattacacttgtttacatctcattaatgaaaagatcatttattttcagctaaaaaaattctagatccactttttgttagatgttatttttttcatttttgttataattactgtacaaaatgtcccaaaatttgttagatgttcttacccattgcatatgttaacatttttatttattatgtgcaaaacatatgataagatattgaacacattggtgaaaaaaagaaagatattgaacacattacaagattctttttcttgatataagatctgcacaagtacaactgtgattccttttctttgtaaagcgaaatcgtactttagctagtttcttcttctagtactcaatttggttaaaggcatcaacggttacaattctaaaatatggacataaaggagtcgtgtgatataaacaaaaagaacaaaaacatttggaccatatatgtatttctgacgcaaaatgtaacgtcataatgacgatgatacacagaggaatacacgtctaacttaaataaaaatgaatcgttatgaaagaaacgattttggaatctaatcatggaccaataaagagactagtgcaggtcccacgacctatcccgcctggtcaaaccagaagcagccatgtggtctttcacttctctctctctcttacattaatacattcagacattgacttcactgggtcccactcttctataaagtctctctgacaacgacaaaattttaacgacagaacccgagagagacaccgctgaaagtgaaacactatcctatttatctctcacaaatacaagcgacaattttagaaataaataagaaaaagttaaaataattttttatataattctaatggataatatctaagtaattttttcactagcatgttttgaaatttcaataatttaaggacggagaaaaaaaaagaagaaaagttagaaaagctgagagatttttttctttctttttttcctcttttcctcgaaattcattcttctttgactgtttccaatacgtttaagaactttttttaaatttattatgtgtcttgataatagagccatagaaaaaaaattgtttgtttaatgtcattttctttttgagtaaagaaactttcttcttttgcaacttgaaaattttcgatttcgagagcgaaggaagagagagagagagggagagatcaaaaaaatttgtgaaaaaagagatttattttagggttttgttgattttctttgttcattttgccgtcgtctctttctctttctcttgtgaagaaaaagaagaaaa

SEQ ID NO: 156 - DNA, 3000 bp, Arabidopsis thaliana
tactccccaaataatatagtaggatttgtactagttgtccatattcgtatttcagttatattttttgtatcaattgcattattatatttttgttataccatttgtacaaattcgtatttatattattattttttagttataccatttaaactagattgtcatgtgatctctcatttgtaacagctgtattattatcttttagttgtaccaaattgtaccatttcttctgttattttttaaggataatttagagatattatatttataatgacactcagattacaagatggtcacataatggcataagttagcggtgggtgttcaggttgacattgggtatttcagatttttgggtttttagatttagagatatagaacccgtttggatattcctagatttcgggttcggatcagacatttctgattcggattcgaattatctgaaattcccagaaaatcaaatcgtttataactaaatctgtccaaactactaatacacaaaatatctaaaaatcttgaatatttttggaaaaattctttttaatgcccttttcatactaccctttttcaattctacccttttctatttaccattttcatttataccctatttaaaattttaatgaccattttacccttatttgtaaattgatttaggttaacaaaatgaaatattaatatttttcgcttaaaatattccaaaataaaatttccagccaaaatttcccgccaaaaattttccaacaaaaaattcccgccaaaaaatttcccaccaaaaattttgaaaaaaaaaattcctgccaaaaaaaaaatttcccgtaaatttttttttttgggcgggaaatagattttcaagggattttaaaagggttttaaaagagattttaaaacggtttaaaagatttacaagagattttaaaagggtttaaaaagattttctagagattttaaagggctttaaaagacttacaagagattttaaagggctttaaaaggcttacaagagtttttaaagatttttaaagagtttaaaagtgttttaaaagatttacaagagatttttaaaaggttttaaaagatgtacaagagttttaaaaagattttaaaaaaaattataagaaaaccctttaaaaactcttgtaaatcttcttaaaacattttgtaaaggttcacaagagttttaaaatggttcaaaaagagttgtaaatgttttaaatacttacaattctttttctaaaagttaaaaaatgcttgtaaagactttataagagttttaaatggatttacaaatgtttaaaatccttttcaaactcttgaaaaactcttgtaaatcatgttttacccttttataagcttttaaaatccttgtaaatcattctataccacttacttatcttttaaaaacaattgtaaactatgcaaaccttttttaaaatcccttgtaaatcattctttgacacttacttatgttttaaaaacgattgtaaatcatgttaaacacttttaaaatcccttgtaaatcattctatgccacttacttatgctttaaaaacgattgtaaatcatgttttacccttttataagcttttaaaatcccttgtaaaccattccaatgtcacttacttatacttaaaaaaacattgtagaccatgctaaccatttttaaaaatccttgtaaatcgttctatgccacttacttaggctttaaaaatgatagtaaatcatgttttacccttttataagtttttaaaattccttgtaaatcattcaatgtcacttacttatgctaaaaaacgattgtaaaccatgctaacactttttaaatcccttgtaaatcattctatgccacttacttatgctttaaaacgattgtaaatcatgttttacccttttataagtttttaaaatcccttgtaaatcattcaatgtcacttacttatgcttaaaaaacgattgtaaatcttgtaaaactattgtaaaaagttttaaaatgatttacaaaggtttaaaaggcggtttaaaagtatttatctatgtttttaaagactttataaagattttaagaggttttaaaatgatttacaagggtttttggcaactaccaaagcttttaaaaaatttacaaggatttttaaaagcatttttttggttgggaaaaaaaatttacgagaaaaattttggcaggaaattttttttttggcgggaaagttttttttttggtgggaaaaaaggtttggcggaaacttttttttggcgggaaaaataaatttggcgggaaactttcagtttccaattacatgttcttattagatgagggtaatttggtcattctgttcaagggaaatgatatttttaaaaataaacaatataaaagggtattgttgcaaaagagtagtaaaaaaagggtaattttgaaaatctcccatatttttgacccaaatttattcaaaagtgattagatacctataaatattataaatatcacaaaatttatatattttgacacaaattattacaaatataaatattaataataatatattattaatatttatattgtggatatgtacagaaacccgttggaatcggatttgggtttattttttttggatttggaataaaactgggtattttgaaaatttgggttcgggttggatcaggttattattggattcggatcgggtgttgggtttggatattatgcccagcaatggtgagtactcctctcgccatcatcagtctttactctgttccaagtcttccttctttggctcaaatggggtccacgatcatcaatccaaatagattcgactttttgttctggggtttcgtcgagaattcgatttttgggtttctttcgaaacttggtcaaatgtcgaatacgcgttacaaagaacaaacctttctctttatttcgtttgtcttcgtcaacggctgaatcaaccaaatggtccctggaattaataaacctctaataataatggctttgcttttactctg

SEQ ID NO: 157 - DNA, 3000 bp, Arabidopsis thaliana
acaaagaacatcaatggaaggattcagtttcttcaaggtcatcttcacgatcgtcatcgataacatctgcttcttcggatggacactttgatatccgacactttcctcttcccaagccatcattgtctgcttctgaggcacagaaactgagagagtcacatcaggcttataattcatctgttagctcatataccagttcctcttggtcctcaaatcaccagaaccatcttattgatttacccggttacgatccaaccagaattccatcctcagttttctctagtaaaccgggtaattcgacggaatggagtctagcttctaatgaatctttgtttagcatccacgatgggaattttagcatttcaacagcgttgagattggctgagataccgagatttgaagaaacggttcacgtgataaccgaaatcaactcggttcctcttccacctccggttaagaaaccaaatgaatatgagaaagagacgattgcagagaaggaaccataccaggtggagaactcaaactcagatattgaggataatgaagaagaagagaagatgagtgaagtcgagagcgacgacgaacatgaagaagaacaaacagatatgatcgaagcggaggctttagtagagaaagaagtaatagaaactgtgaaggagaataaacctgaagactcgaacagtatagtttcacattctccgagcatttcttgtcgttcggacactagcaataacagcattggttctttcgcattcccactgtaagtcgttctcttcaaaatctcaatttatcgatccatttttgatgatttcttgagcaagaagaaactttaaaaccctaattttactttctttggaatttatgtaacagattgcaaaaagaagatgcagttaccaaaacgccgtctatgcaaatcaaaggaaacgtttcccacaagcgaagacccgagtatcagctgcctcaatcgcgaatgctacagccacaacaacaactacaaccttattcagaatctaatatgctaactgagtctcagccggaaccacaaccacaaaggaaggcatcaaaaaaattcgagtctcgaacgcaatcgctaaaagcttcaagaacctgctggttctcttgcttccattgtccttcaaaatgcggttcattcaagtagaggagacttttagcgtttgcgtttgaagcgattcctcttcttatgtgtaaattgtacggatgaaaatagttgtaaaccaagagtgatgatccaaaccgagttctggttttcaggattaacaccatattttggttcgattaatttcggttaccggatgttgtaaaccggttgatggatgatataactcttatgtcatggtgatgcatacatacaaggaccacatttcattattactttatttcaatacgtatcattattataagtagtagctaaaagacagatatatttcactaaaagaaaaacaaacctttttttcttctaattgaaaaggttataaactcagtctttttatccccataaatgtggctaatgtgttgtgtacatgacaaaattataaatttatatttaagaaaaaacattttaatttgctttatcttgaagcttcctttagttatatccttgaaaagaggcgattctgtccctttttcactttacaatttctcaatatttttgttataaagaaacacatctttgtcacatgcatttatgtatagtggcaggcgatttttcttttagcgtgagattatgaaattttcctaatataatgcatgtccatatacatatatctatctgtaataaatgttagcttcaagatcttagcataacattggtcgatgagagattgatacgtctaggagagttgaaatattgttacatttattgtgactcaacatattttatttcatcacttcgaataaacaaaaaatttaaaataatctgtcctcaaatttagtgataagataatcttgcatctacctactgttatcaatcatgtacctattgcgatttgatgtggtgagactacaatgatcgatgttaaaaacttttaatgttaacttcactacatgatcgataaataatcaaaaattgcttcttccaagttaaaattacactaaagagtttgttagccaataggaaataaggaaagtggacccactctctcattcacagaacgattttttatttttttctgcataaattaaattaaaaacatttttaagatcttttatcaaaaaaaaaaaaaaagagagagagaagaaaaaaacgcgtcttcctcagtgacagtgttgaattctctcatctctttctctctctgcttcatcagtttctctcactacaaagcttctcatcatctccctaaattagggttaaagggtcgagcttgggattgtttcgcacggtaaaaggaaggatcttttgctcgtcaattgctatattagcagaccttgcgaggtgggtttagggttttgttgtaaaaacatttttggggataagttacgaagatgacttctttgccttcttcagtgatcaaatggcgttttttccgcagacagatgccttcagacgttgtcttctcgctctgcttactctgtttcgcctcctgtctcgccggaaaaatcactgttttagctgattcggacaaatccgtgttgcttcggtttaagaaaacggtatcggaccctggttcgattctagctagctgggtcgaagagagtgaagattactgctcctggtttggtgtatcttgcgattcgagctctcgagtcatggctcttaacattagtggctctggaagttctgaaattagtcgaaatcgtttcacttgtggtgatattggtaagtttccgttgtatgggtttggtgttcggagggattgtaccggaaatcatggagctttggcggggaatttgccttctgtaatcatgagtctcacaggacttagggttttgtctctgccttttaattcgtttagtggagagattcctgtaggaatctgggga

SEQ ID NO: 158 - DNA, 3000 bp, Arabidopsis thaliana
ttttcttttctggcgggatttcgccattctaagctatttggttcccgccaatgcgctagtgccggcctcaatcgttttaagaattggatggatatttttggtcattataaaagttagagggttaatttgtattaataaaaagaagaaaagttcatttcgaattgtagtgaaagtttagggttttatttgtaatatttaaaagacaaaaacacgcgaatccaaaaccgactttgccctagttaaaatctcgtcgtctccttcgtgttcgagatttgatatcgactaatcgaatcagaggataagagaatggctcacagaatactgagagatcatgaagccgatggatgggaacgctccgatttcccaatcatctgcgaatcttgtctcggtgacaacccctacgtgcgaatggtgatttctcgattccttctctcaaacattcttggattttgctattgcttgttttgtttcaatggctcctgaatcttatttccggatctcatctcttaaccagtctcttgctcgttgatgttttctgtatattggagtggttaacttagtaaatatggttttagggtttagcttgttatcaaattcatcgaaaaattgggttttacatccaaattcgtttagttatagttggatttgattacagctgcggattctcttagctttcagctgcaattttgttttctgaaaatctcgatgttttgatttctgattgacgttttatctgttgatatgtagaccaaagcgaattatgataaggaatgcaagatatgtacacgacctttcacggtgtttaggtggcgacctggccgggatgctagatacaagaaaaccgaaatttgtcagacttgctgcaagttgaaaaatgtttgtcaagtctgtcttctggatcttgagtatggtcttccagttcaagtaagagacacagcactcaacattagtactcatgactctatccctaaaagtgatgtcaacagagagtattttgctgaagagcatgacaggaaggtatgatcatgttcacactcacgattttatttcagcatttgttggtttgagaattttgaagacttactctagctttctcatggtggcttatctaagtgattttgctttttctgttatgtaggctagagctggactggattatgaatcttcattcgggaagatgcgacccaatgatactattttaaagcttcaaagaacaacaccgtactataagaggaaccgagcacatgtttgtagtttcttcatcaggggtgagtgtacaagaggtgctgaatgtccataccggcatgagatgcccgaaacaggagagctatcccagcaaaacataaaagaccgttattatgggtaagcttttttcttctgtatgtttgactttgttgacgtttagttccgttctttattggttgtttcgatacctcccctaaggagtgtaaaatttcatatgtttctgccatagtactattttctccttgatcattcataatatactcgatatttgaaagcttctgatatgtgaattcttggactgaactatgctatgttggctctcatgtagtcttgttacatagtgtcgtttccagttttagttctctttgtaatgtattagtacttttgcatttattcttgttgaagagtttgttttaactgtttctcattttcttttacacgttttcagtgttaatgatccagttgctatgaagttgcttggcaaagctggtgagatgggcactttggaatcgccagacgatgaaagcatcaaaaccctttacgtcggtggacttaactcgagaattctcgagcaggacatacgagaccaattctacgctcatggagaaattgaatctatcagaatcttggccgataaagcctgtgcatttgtcacatacacaagccgtgaaggtgcagagaaggctgcgcaagagctctccaacaggctagtcatcaacggtcagaggctaaaactcacatggggaagacccaaacctgatcaagatggtgcaaaccaacagggcggtgtggctcatagtgggttactacctcgagccgttatatctcagcagcacaatcaacccccaccaatgcagcagtactatatgcacccaccaccagctaaccaagacaaaccttattacccatcaatggacccacagagaatgggtgcagtcatttcaacccaagaggctggtggttcaagcactgagaacaacggagcttcatcttcttcttacatgatgcctccacaccagtcatacccaccaccaccatatggatatatgccatcgccttaccagcagcagtatcctcctaaccatcatcatcaacctagtcctatgcagcactatgccccgcctccagcagcttacccgtacccacagcaacctggtcctggatcaagacctgcaccgtctccaaccgcggtctctgctatatcacccgactctgcacctgctgggtctggagcaccttcgggatcctctcaacaagctcctgatgtttctacagctactggttcgtctcagtagagaagaaatatcgcttaaaaaatgtactgcaagtttcccgctattcaggacgaaggttttttgtattctgaatgaatcattttcttctgctttttaaagtacttcggaatgtattgtttcttcaaaacggttgttaacgaaatctatcagttatagaggcaattggttccatgaagagtctgcagttattggccaatttcataaagaactttgagaatattattatcacaaatttcacatttgctcgaatcgtttatttttttttgagaattctactagtaatttggataaatgcaaataatctgggaaatacaattgggccttttgtgagaagaaaaatcgtataaagctgggccggacgccaaactgaaaaatgtgatggaatttttaaaattcaatcgcgtccgactttcccgaagcttctttctaaatcctctctacatatattccccactcatat

SEQ ID NO: 159 - DNA, 3000 bp, Arabidopsis thaliana
acaagagcagctagaaacacgacatcaaagctctttaagctctctgtcacgtccattatatcaacggtgtggaagaacatgcgttgagagatgtctggatcagaggaaaccagaagagaagcgagtgagttcgctgatgggtcgatgtcaaagttgtgaaagattgtgtctttgagatggaatgaagcaagaacgatggaagtgagaggaagaggaccagatccaatgaaagccacactctttgggacaaagccatttaggttttgttcgaggaggtcgaactcgagctttccgagtttcaaatagttgttgtaataagggaaaatgtttaaatgatgaagtgggttgtcttggtaagaggtcaagatcgaagagaaatggttttctaagtgaccttcggctagaccacaaatcttgatgagattaagtcgaatctcttggactctgtcacacatcttggtgacatcgatgttagggtttggtggtatgcatgtggaaacgagctgcttgaagagaatgttgacatcttcggatggttttagactctcaagctttgagatcttttcgtagagatcgcatattgtttgcaccaattgttcgtcttggcaacccatgtcgacactatgaggttattgatttttctctttctctttggagaataatcgtgtgttctcgggtggtgtgaactgtttggactggagggatggatatttattggcgtggggttggggatctacatcaactagaaaaagaatctaattattttaacatttcattattcaaatatactatataacgtacacttgcgtttttgtttctttttttgtttaactaattaagaatagatccttatatttaggttttgaagtaaaagatttatttaagtcaagatattagtttaatgtttacagtattggtttagtttctatgatttctgatttaggtttaaggttttagtttaggtttagagtgtatgttttcgattatagaaatttcattcctaattgctataaaatttacaatcattttcaaaattatcctggttatgaaaaatgacttgtgtgaacatggattagatccaaaaatgttataaattattggatatattgtattacactaagcaagatgtacagtaattgatggatgatatgaaacgtataatctccattaattgatggattacatgaaagctaaatgagataatttgtttgttttattccattcttctgtatataaaaaatgagataaggtttgaatgtgtccatgtagtacttcttccaactcgtatgagacaactacacaaaagtttgatgccttatcatttttctgtacgtagcatatgatgtaaacacataattacacagaaataaagagtccattactatattatggggcagttcaaaatatatagccaagagcttttagtcttttagaaagaaatgtgcatgacttgcgacaacacaaaaagtgtaactaaccacagtaattaaaaatatatatatggagtaactactaacctatataacaagttgcttgaccgaaaaacatacgtcctttgtctgtttccaaacatcaactttggaattaaattgtaagacttcctcacaaatatcaaactgagttttcaatattttttgaaaagaatatgcgaatttcagaagaagataatctcttcatggcgtgtgccttccacaaatttcttacggctctccttgttttcttttgatatgcttcatgaatctctcaaattcttcacgcaatcatatatattttcatatctagaaagaataataatttttttttttttatctcaatatagcttttaggaattctaggagagtagcatatatgggatatatacgttgacaaaaaaaacacgtatatgaaattggaatccatgtgagacgaatataaaagattggaagaagacacaaataataagaggtacttaaagatacacacacacacaacaacttgaaaggatcgatattcttttatgtaaatgacgcatcatatttatttcttatgcgaaaaaacatattcgaaacaaagaaaaaagaaaacatgtttgatctatgcatttttgcctcttctattaactccacggccaacttgattaattatatatgccaacaaaattcatacaacactattaatattcgtttgtttttctccttctcaatttcaacattaatttttaaagttttatgtttattttttgtggttgtcagtcaatggattccataatgtatatattattttcgtagagatgctaagatttttttttctcttctttttcttcctgtataaataagattgcgtgaagaacttgcggaatttcatgagtgagacaagaaaacaaggagagccataagaagtgtgtggaaggcacacgccaaaaaagatattatattctcagagaaatggacatattcttaatatttccaaaaattgaagtttcagtttgataattgtacgaaaacttacaaaaatttgtcaatgttaatgttttgaaacggatgaaagaaagtatatttagtcaagtaacctgttatagtcatgttcacttcactatcaactctatcttcttattggattgcattgtccatctcccagtttattcttcttctttttcaaaattaatttatttcctcatgttacattaacatctatctattgatttttttttttttgtaatgttaaatttatttatcaattaaagtaacaaaatatattactgaagatttaaatgattgttgccatttgccaaagctaaagagataggtctgttaaccaaaaaaaaaacattttaatgggccacatgtgtggaaaagcccatacactttaaaacaaaacgtctccccggtttgattcaatcttctctcttggtttttctggttcggtaacttaccccaaagtctagtccggtttaatctcccaaatcaattttattgaaaagaacatgtcatcgttctgagtttgggttttcgagctctaata

SEQ ID NO: 160 - DNA, 3000 bp, Arabidopsis thaliana
gctttgagtatggtagctaggcttcctgtttatttgttttagatgttgtgctcatatgcttagagagggtgtttactggtttagattaatgtattaacttcatgtaacttctcgtttcaatgtttactgtaggaaagaggtgagaatataccaccagaagattcattcgatgtagcccgtaaagtgaaggaaatgtactgctacacttgttctgacatcgtaaaggtaatccttagtggtgaatattcaagtcagataatattaatatatactcttctgaaaatttattactggcctgtatgctgaaatcgcttgaaaagaatataggaatattgataaagaacattcatatggttgcaggagtttaataaacatgacaaagaaccagcaaagtatattaaacaatggaaaggtgtaaagccaaagactggtgcaccatacacttgcgacgtgggatatgaacgattccttggacccgaggtttgttaccatctatctgttataaaaagttgtaagttgataagataaccagaatcggagactggatatctttactggtgcatgagtttctagtatgtcagtgagctgttcatgatttgttatcgattataagatattttcagcactctgttctgattactgaacggtactgatataaaactatgctctctcagaaactcaaattaggtaattacttagtccattatgttaactggaagtctggaactaattcttatctagttagaattcagctgtcactactggacccataggaagctaatctcctttgtatctctataccaagagagtaactggaaagtggaacataatttcctttattgttcttgcgtttttgttctgctattaccgatgagtaatgttgagattttgtgtgttacaggtgttctttaatccagagatatacagcaatgacttcacaactactttaccagctgtgatagacaaatgtattcagtctgcaccaattgacacacgaagagctttatataaggtttgaaacgccaaagactggtcagagttttaagataatttccaatccgcaatactgatgaatttgtgaaatcatttcagaatatagtgttgtccggaggttcaactatgttcaaagatttcggaagaaggttacaaagggacctcaagaagattgttgatgctcgtgttcttgctaataacgctcgtactggtggtgaaattacggtaagaaaattgtatgatattctggaaaataaaagtgataaccagttttcttaatctgaggtgatatttatttataaccacagtctcaaccggtggaggttaatgtcgtgagccatcctgtccagaggtttgcagtttggtttggaggctctgtgctttcatcaactcctgagtttttcgcggtatgcaaactagtttagagatccgctagtttgaagctaaacctcatggcttgatcgtgttttgaaacaagatgtatttttgttgttgcagagttgcagaacgaaagaggagtatgaggaatatggagcaagcatatgccgcacgaatccggtgttcaagggaatgtattgaagctgcttcataaataattcaccagcagattctgtgaatgtttgtctgctttactccatttctattactgactttagggttcttgagtacacacagtgtaagctaggcttgatgtagaagtcatattattattcagacaaattaaagaaaaaaagtatgtagaagtttgatttttttttcatattattttctgttaactcaagcattaaattccacagaaaagttccggattatcaatcgtctaattgtcaagttatcattttttataagcttttattccactcaagagcttaagttctagatgaaacacatgataattaagttttgtctactttatgatgtgttttattttttataaattagttaataatatttaaaattagacatgaatagataaaccttcttttgggtaaaatacacaaaatcattttcttaaattactcaaaacaaatatctttcattactctttggttttggagtaatgtaagatattctgttgttaataataaaggaaaaaactttcatgggaaaaaaaaatatatatatatatctttcatatgttctacaaaatacattattacatttatagcttgttgtataaacgcactaaaaaaacatgtaaaagaaaaaagtttgttaagacaaactgttgacatcacggtgaagctcttctttcattttttcttcttctatcggataagaaagagaacatcccgagtctcgacgaatacgactctcttcctccgatctcatcaaaaactctttcgctaaagctctgtttctgggcgttcaaacaattccggagtttgtcggattctcaacttccgtatacggagaaggtcgagcaacaagtagtcaaagtaagcaagcgtagttttttctctctgtctttttctttccgatcctcaatttcacgaggcaatcaattcaattctattcaattcgatgttcttactctctcgttgaactgtaactttcctcgtagatctagtttgtttcttttccgattttgtaagaaccctaatgtttatagatttctcggaaagggttaaaatttgtgtagccccttcattgtaagtcacactatgtatgtaatttgatctcttctatatgtatttatgaaatcttgtaacacccttgtttaaaaaatcgagctagatcccaaatttttcagatctgtaatctaaagttcctcttttttattttaattcggacatattgataatggcttgtaacaaagtctcagcctaattgaattggcagagttgtaatttctttgaaaagatgtattttttttttaagttggtcatgtaaaaaagcaagcaaggatattgtgtagaatgttgttatttgtaattttctgtggaaggatgtattgttacagttttttaatcttcttgtattttctggccagtttgtataaattca

SEQ ID NO: 161 - DNA, 3000 bp, Arabidopsis thaliana
aacctatcaaactaaaaggtgttagaaaatattgttggattaaatattataatttgtatatagtaaacattaaaaggtgattttattgacgtataataatctaaaaaccaaaaataaaggtgatatattgaatagaatttaactatttagtaggaaggaagcaacatgggcaaattgccaatttggtttataaaggagcccacatgtttaccttactattttggactttctgagttagtgtcgaaggcctttgggcccataaatggaccccacaaaaagacaggacaaaatatccttagaactcgccacgtagatatctcgacgtggagatctgaccacgtgtacagtttatgtcctgattttcgcaagagtgacgtggacgggtcatgatccgcttatattttcactttgtctacaagccaagtatattaaattgggcctcaaattagcccaatcaatatatcagtacattattaatcaaaggcccaagtctcacgctagcgatcgtcgacaacgattttgagtctttctccgaagtcgccggaatcgtattcgccgatccaattgtcgcatagaaactgtcatctccggcgagagactgatctctggtaagtcaattcgatttcgcgcgttttataacttctggtattttcgtattccgttgctgagagaaaatattgcagagattgcttaacatgaagctgatactttaaccgattcatcaaattgacaaaaatcgttttcttctttagggattgatacagaactcgtaggatgatcgatttacgctataaagaatgctacttgctcatctgtcttatcgtcttcataaattttgtgacttgttatagcgatgagagactgtaagtgttgttgaaaaacctcacattatccccaaactcatcaatttggattcttttattggtactgtagaaatgatgttatcaggtttctcttaggtttggtggaaaaactttatatgctgggaaggaactttggaaagagacactgccattgaaatctggatctcgagtttacaaattacaagggcttaagtcgaactcttggtatgaagtcaagatatcatacccagcttctgtatgtcaaatttgttatcttgttctatgttcttatgtttccaaggttcttgtgcttgttaaaaatctcatccttttttgttatgataacagataccggctctattttcgctgcaattactgaagaacggtgtaatgggtttgaaggttaaccatatgaggagattactaaacactgagaagttgatcttcaaaacagaaagtattgaagaagttgataacaaggtattgccatcttcttcagttagttcctaaaacttagaaagaagaacgaatacaagtttaggagtttgtttctgatttaggagggattgtatgttttggtgacggtggaacctgaaggaatcgtggctataccaaatgttaaagaaagaccgtccatcatttacaacataggcaagcttttttttctacttactatctcatcaatcttcttcttttcacaacataagaacttgtattaagtgtagtgcttcttctagagtctgaaaactctcatgttgacagtttgtgaagaacagctcttaggcatccctcactcaagctggtcagtggtggttttagtagttttgtgtctcgttgtcgcgttgattcttccccggttcctcccatcttatcttctgatcaaagatgtagatcgtgatcgttaagaagaagcatggttaatacagtttcctcacctctttgttttgttactctgttcgcattttgatgtttgttcatctaattttgtatggtttttagttcttacatgtccactgcctcattcatataccttaccttaccacaccgcactcaaagaagagtatataagtctacatgtgttagattgatttcatgtttttcagacgcgggaagtcctattctgaacttgtatggtttgatcgtatatagttaagtaacgcttatccgtttgaatttcaatccaacaaacaacattccacaagatgaataactctaaagtacaccgtattatcttttgggaatagggagtaattaattaaaagcaaagaggttacacatatttttaataaataaatgaatttttttttgttcatataatgtatgaaataaccgttaatttcccggcagtaatccgctaaaataactccaaccaactgtgataataaaagaaccaaactaggattcggacaaaaccacaatttgtgttctaattaattacagcgttaatcataattactagatgatttcgagtgggacccagggtgaagaacaactccttttgttttctctctctctcgaagaatttatgaatcataatcacgcatcatcgtcttcgtcatcaccaacttcttcaccatcatcatgaatgttaaaacttccataaacaaatccttccttgtccccttgtatttttctatctaaatccctaaaaccactcaaaatcatccctctttctctcctccccattttccccaacgcttgattcgaattcgtctctctcgttttctgttgttctaccaattgagcaaccctagaatcattcttgtgtacctaccggaaccgagtcttctcttcttccgtggcacatctttcaaagttttaaaccccttttcccctaacttcttttcatttttctgtttttttcccgggaaattttctctctctctctctattttttgtttctctcgtcatgatcattacttgtcaagtatgatcctttattaggtttctttggggccgatctcactttttctgtttctcaccctcttctcttcgaaggcccttgtaaaccctagaatctcctcttttcaaatttatatgttctgtttcttcatcttcaggtttaatcattcaatctatctctagggtttaccgggtcaagtcttaggatctgtctctatccatacttcatcaaagtttccgtctttggttctaatcc

SEQ ID NO: 162 - DNA, 3000 bp, Arabidopsis thaliana
tgtaataatagtcagaatttggtgtccatgcatcatatattgactcacttgtcacttctcatcggcaatgggaggatttgcatctgttgtgaatttgcttgggagctgttcacctgtttagacatgaccttctgatctatatgtctttgtatttgtaattctctgctgggttatcaaaaccctcagctgtgttcctacctttaccaactgatgttcttagttttctgagcaagtgcacgtctctctccggcctacttttttgaatcatctaatcataggtactggtgtatttttgtcttctgcattactcacgtgtgtcggaaaagtttataaatgctggtttcggtgaaagtgatgtctagctattagttgctgcccgagatatcataacattgaccttgttcatgttaaaggtttttgacaatctcattgcttcaggtcccaggttacaatatcatgtgcaatggtgatgtgccacaggttttacatgcgccaatctcatgcaaaaaatgactggcaggtaagaatgctttagtattcatatggttcatcaattgcgttcattggagctgacatgtaaatattaatgattgaatagtctgcaacagatatattgattcttcttacaaaatttgggttatgagcaatataatgttgatgaaaacaagtcaaaagtggttatttaatagttattcagtcttcctggttaattagaagtgtatatgattgctgctaaatatttccacttcggtttctcactcggtgattttgcagacaatagcgacttccagtctgttcctcgcttgcaaagctgaagatgagccatgtcaactgtccagtgtcgttgtagcgtcttatgaaataatttatgagtgggatccttctgcctcaattagaatccatcaaactgtaagtgtatacatacatctatgtattggtaaattcgcactgtgcattttgctaatttattacatgttgctctgcctgtaggagtgttatcatgaatttaaagaaattattttgtccggggaaagtcttctgctgagcacaagtgctttccatttagacattgaacttccctacaaacctctggctgcggctttgaatagactgaacgcttggcctgaccttgcaacagctgcatggaattttgtgcatgactggtaaagacccttgttaataatatctgcccgatttttcccctacattgagtttgaatcttattatgcattgtgtgtaggattcgaaccacactatgcttgcagtacaaaccccatgttattgcaacagccactgtgcacctagctgctacgtttcagaatgcgaaagtaggcagcaggagagattggtggttggagtttggagttacaactaagctattaaaaggtttgctgttcaaactctattttttcctctggtattattgcagtcatttgatcaagtgagatgtagtgtttctataatgttagcgctaggaatatgtggtactgtagctccagctcatgttaggttcttaccctgtgcacatattgagtttggaattaggtagtggcctgaacgaagagatgtgctgctattgattttagcggttgattaaaaataattggatgttttcattatggtgacagaggtaatccaggagatgtgcacactgatagaagtggacagaaggaggaatatgccacctccacctccacctccaagaagagagttaagttgggcaatacctgcagccgtaaagccggtccatatggctagagcttatccgtttcacagctaccctttgcagtcctatagacaggctggcatctggtgagccattgttgagcagcatgaagatgtaatctctcttagagtcttgagttggtttagcaataaaagatttccgtagagactcatgagagaggcagtgtagcattatatagagatccgagtgaggtgcttctgtctaagttaagcgtctcatgtatgaccaaagtggattctctcgagattcttggtctctgttctcgatagagagagattatgtatagaagtgtcccattcacatgttataatactagctgactttatatcgtttgtatatctggaatctatgtttttggtttctttaaaaagtttaaagttgttttgattttgactaattctctcattgttaagtaatttggtttttgatgaagtgctattaggtctgtgttgagttgagacttgagacgaacacaatcatcatatgatcaagcttataccgatcggataagtaattaaccggttcaattaactacacctagcttataccgatcgtataaaccggtcaagaaccaaaaccgcttggtttccattctagaccaaaccggattctagtttccattattattatcttttttatcggattaaaaatataaatccttatgtcaggagatcccattctctgtctctctgtctttctcccccaactcgcgaacaaagcaaaccctagatcatccatcggcgagtgagacggcagctcctcgtcggtaattccttccaccggcggcgaccactcaccctcagatctctcaatcccactcatctctgtaacattctgtacgctttctctctctctttcttcgcttttgtgatctattacggctcggtctctgtgcctcccagctctattttggagcactgcttcgtctctgtgtttatttggctcctttgtgtgtttctctatctctgcttttcttttgtattgctctgtttccgattttatatccatatgtctctggttatttggttatatctatgtgtgattctttgttcttttttccattgaattcaatagctgactaagatctctgccttttatcttcaatagttgctcaatcttttcgctttcgtaacataatttagtttcttgttgatgtttttgatatctaccaatctcttttcaatttatgtctatatgttgctaaatatcttgttcaatgactgatttcttaaactcagggtggaaattctgcc

SEQ ID NO: 163 - DNA, 3000 bp, Arabidopsis thaliana
gactagaaagtagaaactgtagattaattactttaaaaaaaaaaaaaaaaaaaagtctatgatcttaatccaagtgagcctatgatgttaacaccttaattttttctttttgtattgtgtactatattatagctctaacgtgaagaaataaaactagcaataaagaataaataaaataattagagggtccagttatatgatgaagtgtggtatttcttaacttctttgcaaattttaattatctattgtttacttctataataaactactcatgctgactcggtctagtcattatttcattgtttcgtacagaaattcactagtaattttgtatgttatatttttaattttataaacgaatatagaatgttttatttctctttaacatttctaaaagtcatggatcattcaaatccgtatatattagtattaagcaactaattcgttttaatttatagatcctcaagtatagatacatataaggctgcattattttccttgtgtggacgatgacttgacatctcaattaattgttatgggaagataggtatttttgaatatgaaacattatccaggacacttttgataaatcttttcttcgacttttccgacctcccggcaaataatttgtcatgtatgtacgctcgatactatgaaataaaagatgaatttatttcaatcattgatatgagatagatggggggaaaataataaactaaatacatacaatagagtatttttgaaataaattcatattaccaactaacatcttaaagatgttgcattattctttggtcaaatattggtctacttgatgattccgtatggcgtaagatcagtgccgcgtaatttgattaactaagattgttttaaatttctgtaagagattacaattaaactaaactttttatatggggttgagtcgttgactatatgtgcctgaccatccattattcgacaacaacgtattcacttcatttggatgatactcagtcaattaagcaacatattggctccgtttttatccaatttgattaagtaaaaaaaaaaaatgtttcagatagtgtaagaagctacgaagaatttatgggtatgactgaaagttgaaactttctaaagccatcacaattgtatactttacaaaatattaagatacattgctgtcaaattttatagttttttctcgtttggaaaatatcaaaatatatacctaaaaccataaactatatgctgtctttgttagtcaacattattaatttgaaagatattaaaatatctcattcataaatacaaatatataattttaaatatcttttcatattatttattaaataaatttgattttctttttatttaatatattttttcgtaaaccaaatttttttcttacatcattttttcataaaaatttgcttttgacgtaacatattttctgctcgcatagcgcagaaaattacccaattatttttaaaatatctcattcataaatacaatagtattttaactatcgacattattatgctaacaataacaaacagaagacattactaaaaatcaactctatattaccaatagtgtgcctaacgatattaccatgtgtttgctcaaaacaaaaagctcacggttttccttactctctttttccaattatttcctaatcttatggataaactcttttgaaaattcatctaaattcatttttctttttaaaatatgtaaaatgcgaacaaagattacaattccgtatggatacattgtacctctcaaaagaatctgaatatttttagttggtatatccactatcccatgcattagatgacactagctgataataaatgtgtatgtcaaaaaatgcatagtaattagtaaagatactcttgactcaaataaacttttgatttcataaaatcttaacatattaatgggatagttacaactgtagatgatgatataacagagataaacacggaagtgtcaaaatcataggtttaaaaaaataaaataaaaagtgtcgaaatcgtcggactcaaaaatgtatttaaatacagttaagaaaaaacctctttagccacatcaatcattctcatcctttcttgtcttctctgatatttttttttctccaccattattgtttcttctctctctctattaaaccctcaaaattaaaaaataaagagacaagttcaatttttcttccttcttctcttttttttttcttctcaattttaattttattttggttggtagagattctctcttttgctcttcgtgctttgtatcgtgatcatcgtcggtgttggtaactgcacatttcaggtatttactcttacctcctcactttcgcaacaaattttgatttctgggtttttcatgtttttcttcttcaattgattgggttttctactgaaaattttcaactttttttctgggtttttgtctaaagtctaaaaccccttcttaaagggtttcttctcttttgttatgtcggcgatttcgatcaatagtgtctctgaaagttttcagctttttgatgatcggagattataagaagtaaattgggttagtttctttttacctagtaacctagttctgtgttggtttgatcttcttaatgagtttaatcatgttatttgttcaacgatcttcttaattttgatgttaattgagttaaagcttcatcatttgactattgtgttagtcaaatgctcaacttttagactttcgaaaaaaaaagattactttcacgacttttgtttgatcaaaacttgtggttttgtattgatcaagcttttttgttggttttaggttatggtttcttgcttgcatgttaatttttcagcacatgacttgagatttcaaatgtgttgtctactcttgtatctcgattctcaaagtttatctgacctgtgaagattttacatgtgattattataaatgtgagctaatgcgtttattctcttttaattttgcaaagcagatcaaaagaaagaagttgctaga

SEQ ID NO: 164 - DNA, 3000 bp, Arabidopsis thaliana
taaaatcaaaatttcttttatttccaagacaaacagtcatacatatatatgccagttagctgttgttttcacctttgaatcttagaatttattttttcaccaacgttggacatgctctttataagagtttggagggcttttagttatggggcaactaaaccttgcacggaattttccttaattagttcatgtttaaatgtatcatagttaactatgtcatggttaatccacaaaaaaaaaaacatattgtgtatgtccaactactcatccatccttttaggttcatccttgagaaccttgccatatatctacttctttttgggaagtacgctcggtagtggaatggatagttgctttttttttttttttaaatggatagttgcttcatcctcaactttagccacaaaatctaaaacttggatggcagtttaatatttttgatctgttaaatctcggaggcgccaaacttttcgtttgggtgaagagatcctttgataactcccaatacacataatgatctgataccaaatttgtttttattagtgtcatcttatataacattttttatttatgataagatgtgaatatattaccaaaacgtagtaagaattttattttaatgagatttactaatataaagttttttttgggttttatttaaatgggttaggagtgcaattgaatcattttttcaactatttcaacttaaatagtaaaaaattgattgaatgtttattcaactcttttaatttcttcaattacgtcaaccatttgcactggtttgtcaattacagcaataagatttttctctgaaaactcattacaagaaaacttgttctattctttagtgagtttttaatctactaattatatatatgaaagttagccaactctctccatatgattgacacatcatcactttaacatttgccatgtatccactgaataattaatgtaagctcttcaacttttaatttatagattaatgatgtatttattatttaattttacatatttaattgtactaatactaaatttattttgttattaaatgtttttcaataaaataatttgattgattttctcatactcaaaagatttttttctgtaatcttaactcaaattatgagtgtatagtagtcatggattaattaatagtttgaatagtttgcatattgttatatatctatataataaatcgccgagggtgaagagtatgtaagaagtttaatcatcaaattcttaggtttcgagaatcccaatattaccttctatttaattagtttaagacgaacattgtttaggaattgtgtgtataatgcattgttgagaatgttgttagaaaaaatatattttaatattaagaataattacttattatataagtaaatgattagataattaaaaattatatttaaattaaacgatacaaaaaatttaaaaataccgcagcgtagcgcgggtgattacctagtcatagtaaaattagtagtgacagattttaaaaaatgacaagcttatgctagtaactttacaaaatagatagcattatataaatattttactgtagtatgagtcaatacttttttaattattaatttagtcaatatatgttagatgcaaatgtatttttttttattgaccaatactttggtagtataatattagtagtattagatattattggctataaatagattcaacattgaaacacaaatcatatatatgaaagaagactaactctctcccacaacttgacacataagcacatgagagcttgccacctagacttcataaaataagtaatacataattagtaattaattcaacataacaactaaaataggagaatataattaatgagaacttgaaccatcactctttctacatttttaattcaatatatcctctttaattttgagatccacttaagtggctaaagtgatgataaaatccaaacatgttacacatattcctggcctaaaaattagacgattattatgaaagaaactaaatgaatatgcagattaaatatatctaagcttttcgatatttatgctaagaaaacaggtaatttgaaagatatttgaggagctatccttataactaatacgtaagatataagattatgacaagaacttaactaaactttctaagaatatcgagttgaatatgcttagattgaatatgcaaagacatgattaataaagacatgttatatttttagtgtaagaaataatttttctaaaatttcactgtctcacaatctatacatataactaaaaaagcaaggatatataaattcaaaaaaaaactaagaatctaaaacaacaataaaaaacaactcaagcacattcgtttttcagatgaactaatatagttggacttttcaaaaacaattacaaaacatatttatgtttcaaaacctatgcattcaactttactttatataaacagacattatataaaacaattagtaaatagtaatacgtaaacccgcacgtagtgcgggtactcatctaatttgtaaattaataattcctcaatttgcacccaaaaaaagaattccttaaccacgaaaaaaataaaaaaacaaaattacaatttaagggggaaagttatatgaaattgcaaatataaccaccaaacaaacaatcgactatcgaggttacccttaagaaaatctttattcgcaagatctctctctctctctctcactcgacgcactttagaaagaaaccctagtccgacgacctctccttcgccgctgaatcctcatcgctggtcagatttctatctatctcgctcttctatgtttccctatctcgttggtcagatttcgaatcttctttttgttctcatggtttttgagctcaaaactttggggtttcaatgtctcgatgttatttcttagcgaggtttcaatgttggctaagtgaagttttggtattgtcatttacagattcttggcggctttctttttgatgaaattggattacg

SEQ ID NO: 165 - DNA, 3000 bp, Arabidopsis thaliana
ttgtgtatgtaatgaaaggtagacatggttgcacgtattcactattcaggatagaaaatggagggaccgataattagaatctcaatttctaggcagagtgtcaattttcttttcttattcttggcattgtagaaaatgacccggaagaaaaaccttaaagtttaatgaaggcgatggttggtgtttggattagattccagcttttgataggtttagcatcaacaatgtcttggttcttgttctttaagtctaaggtttttcttttactatcaatctttggttcattcctgaaactgtcttcaagaaataaccgaaattgaactagaataaacagaatctttggtgtagtttgaacgcaaaacaacttttccattgaaaaaggtcgaacaagacatcatcaaatcatggggacataattatccatgattttctaagacaggacttgcgcaaactctaagctttcgtaagaaaaatctctttatataataataaactcacattgaatcatcagaatcttctgattcacttctctccggttcaactcctgttggattactagtgcctgtctcaggagcttcaggcttttcaacaggtgtaggtgaagaagaagatactttcttacttgcattactagcattctcgttcgtagctggttcctcttgctcatgtacctacaccaaaaaaagttcaaataaatgaagttactaaatccaaggagcaaatatagacacatcatgtgtcgaaaatagaaagaaaagcttacattttctaccgttccgccactcaatatattcaacaagtctctctcaacccgctgtacaagctccggctgcaacattttggcaaatcaatatgttaacttaatagaaagaactttggagttccaaaagatacgtttcactacagactttcaatcataatcacaagtattagtgaaacaatgttgatggatagataacaacaaatgaaaattacattaaggtcaggctctcgacgaaatctcctctttcgagcatccttcattggaggagttagaccatgtctgtattcaactgtattaggcgcaggatcaccaggctccctaaccatgatcatctgtgtgccaaatcaaagcatccatattgagttttagtccaaaattacagaagttaacgcatataagtaaaagatgaatcaagtaacttgattttacctgcccaatatcagcagttttgactaatgcacaatcatcataagttttaaaagactcaacaactgcagggagatcaagcagagaagccgggaactcgtcgtttccaatcataaacgtcccgtttctcccatcctctgcaaattcagttcacacaaacattacgtatcaagtttgctccagagacaatatgcaaatggatttctagacaaactataatgatgcaacaagaatgtcttttggcttctttgacaaaacagacaattcacaacattaagctgatccaggagacacaaatcacaagctttgatccttaatcagattcaagaatgtcttttgggcaaaccaacattcaagaactcatcacgtgacacaaggagcaatccccgaaacgatccagacactaatttcattgattgacgactaaaggacataaatttaagaaaaaggatgaaactttaacccagatgtaatgtgccaaaaaagagagaaaccctttaaaaattggtacctgaaaaaaacaaatccaaagggatttcgtcggaagtagaagcatcctcgcttaaaagccgatcaattcgttctgaaacagacggtggaaccctaagtatgaactgttcttccattgtagataccaacagcttgacttgaattcttcttcttaatcaatccagaaacgtgaattcgcgaacgcagatcgtatcgaatacgtatacttcggtctgttgatgtcgtaagtcgaaaagagacgagaatctattgaactgaaacacgaattctttgttatgttagagagagagagagagagagagagagagagagacattataagataaaccttctagaagtatccttttaacaatttattattttatttccctccctaaaggtttcaagatttatgttttgaccaaaataattataaaaggtacaaacagaacccaacaattggtgaaaaatcaccaatttgctatttaattctattgaattttacatttttagttcctcttagataattgatctcactaagtataaatgtataatgataataaaaaggaagataatttaattaccagaaattggaatggagcatctatcaaatagaaaactttaaggggattttaatactttaaaataattttgagggggttaaatgtaaaacgtaaataatataaagaaaccctaataaataagtcgttcattgatcaatcttctccaattcttgcagcatcacttctccgtcgttcctcaccaccgagattcgttcaccggtaagtcttatccctgatattttgctcttcttcccaaccgtatatacccgtatcttcttctttctctgtcgaataaacttggcttttccgacttcgattccttcaattgtaaacaacttcgttgcccgtacaactttttgagtccggtgaaagatcccgtgacggaaaaaactgtagatcaggcaattattatgtctatacatcgatataaaggattgaatcgttcatcttaagtaagtttgacgaaagttgtgatcttttgtgcctattcacatataacgtttcttagctcctatcttttgaaattgagctgattcgatctctacctgaattgcatgtgatcttattttgatataatttactattcaattagaaaatatgatctttctagattgattgcttctttaaagttctcttagacgctggtgttatagctcttgtgtttgtggtctcttctctcttaaatatccaacctcttttggtgtattttctaatctagtttgtgttgactgactgatagagagattgaagcttgactca

SEQ ID NO: 166 - DNA, 3000 bp, Arabidopsis thaliana
cagaaacctaatcatatacgcaagtgtttttgagcaatatatattagaacatagcttaagcccaacaacaacataaaattggataaataggtattcttgattagagaaaccgatgtatccaatcttgagtgtgtccactcaatcttactaagtgtgcccactagtaattgatgaatttgacaaaagagtgaaaccaatttattaccatttttattcgatccttaacaatttcttaaaagaattaatattgttccattcaacttttaagattaaatattccaataattgtcattgtccaccaaaaactatgaggttcgctaaaaagatatttttccttggatacgtataatgcatatgtacgttgtatgcatgtgggactcaagatatatgtatttatgcatatgtttgtagatgaataaattttaaaaccatataatgtgattacacatgaacgcatgtacgtgtatgcatgtgagactctactatatacagatgtatttatgtgtatgtttgtagattgaatggtaataatggaaatggaccaattggtcccttaggatgtgaaatttcatgttcacatggcaaattggttagtggctagtagtggcccttgtgacagtctatcgtccgtaatctgcgtctctataggtatacacacatccatcgcttctgtcattttatctcatgtattgaaatttcatatgattttcaaatatgtactataaatttttacaatatttagataatgttagatattggctcataagagaaaatagattaggcagagcgaatcaaacagtttaataggatcaagtcgaacaatacaaatcatgtgattttggcgaaacaagtgcatatcaaccggttcttacagtccaaaaaaattttaaatggtgaaagaagtttaagtcatacgtatcaaatatttatattacaaacaccctattttatataaataattttaccaaatttatacaaattatatgaaattaaattttgctaatttatagaatattataccgattaaaataattatacacattatttagtattttagatataaaagaataacacataatgttaacaattataaccataaaataagtgcagatgaattaagctatctactgtattaacctaaaagttcatgttgacaaaacaaaatacataatcttctgacttatttcaaaaattagaagtattgagctaaaaaaaaacatcacaaccaaagcaaataagcagtgtatttactgtacaaggcagatcacaaaatcaaaacaaaataccatttgaaaacaattttgacccatgaaaaatgaaaaagctcaaaaatctcaaaaaaaaaaagacaatagactaagtgaagcaaatgattaaaatcgatgatgcaaatggaggactagttatccaaattaattttcttttcttactttcttttaaagctgcttgttctcttcatatgcatgaattgtaaattatttgtggtacgtccgttttgcttttgaaccttctttaaactagttatccatcaaacaaattgtagcagttttaattataggtatgatttcagttgggatctttctattttgttggattcttaggtttaagaagtatacatattgaataaaaacataatctagtttggttaggatgaatttctcagatttgaaaattagtaaataaaatttaatattaacaaacttgatgtcatcatttagaccaaagccgaagcacatgagtacacaatctttgtttttgataattacgtcaaatatgttaagatttttttgctttcttttttttcaagatatactcaattataacaatatttaaaaacatgagaaataatgattttttttgttttttaaacaataaaatcactcgtttacattgtcacaataaaattagccgttacacaaatttattcgggttgttatttttttttcttttcataagtggatattgtcttaatgaaaattcatataattttttaaccccataatactattttgataatagttgacttcatatacttataactcttttttttagttaaattattttttcaattttataatccaacgacccatccaatatgttatagcctaataggacgtattctgtagctagatttcaaatacaaaactttttgtgaaaagatttggtgtagtttattgcatttgttttagagaaaaaaaaatattaagttctttaaaaacacacataaattgggctttataaataaacaaccataaataataaaacataatccaattttataaaaaaaaagtttttaaaaaaaaatgtagttattacttctatgaatttttttatttataatatactcatccaaattatgcaaaacctcaagctaatctttacaaaataaaatatttaaacaaaatgtaaatattctctcttccaacgaggataacatttttttaaaccaaaaaaaaaaaacgaggataacattaaacagaacatcaacaaacaatacgataagatttgggcttacaatctttatcacaaaggcttttttaaagcccattagttacattcatcattatctctcgacattaaaaaaaaaaagttaaactgaagaagctaaaaagagtttttaacttttaactctcttcgtcttctccctcgtgccgtgtcaaatcaatctactgttctctctcctatctggtaaacttttcctcttcgccatgaaatttttttcttgctagggttttagtttctacagttcgcttcccaaaaattaggggttttgtcacaatttctcaatttcttgttccatttttcttcttttctccataatcattgcttaatttagaatcccaaattttacaaattagggtttttgtttaattttaggggtttttgattttcaactgttaatagtgttctcgatgtcataattctgattttttttattatctattccgaaattagggcaaaaatctcagacaaacctgcaaaattagggtatttgaggat

SEQ ID NO: 167 - DNA, 3000 bp, Arabidopsis thaliana
tttgtctttttcactcaagtctttgaactttctcaagacaagtgctgagtgctgacttgggaagagaaaacgacagaaattggagggaaatgccagagatcattgatggtattggaggaacatagtttcaagtaaacatatttttaattcaactaatctgttattcgattttctgcttcaagcaattatttcccaatctctctcgttgagtaagagggggatggttcgaaatgaaaaaaggatacaacttgtaaaaaagaattgtataactcaattatcaaaatcatatcagttataacaagcaccgtatttggtagacaaaacttgaagtttaaaaagcacataattaactcactctcaacctatgtttcttcatctattcatcgacatccaagtaaaaaaagatgaatctttctggctaaccatattgggcaatacagcagtttcaatccttagtttgacgccttttctttctagatttttgtgatgcatcttcgttttctccttccttagtcgatggaatctggatattggtaagaaagaatgaatcgattaggggttttgacagaccaacaatggttacaaggatacaattatgagcaggctatttaccttttcctgtttttctgatctcttaagctgtcttcgtgagctactgtttccttttatctgcttctcctaaaattaagatttttgaaacaatttgttaggtctcagcggaagaataacaaagcacttgtttgcatttgctagaattcaaaaagaaaacctgtgatggtgtctctggattgtcaacttcttcgttttctccatgtttggttaatgaaccctggatgttcatattaaaaagacgaatcaataaggtttcagacaaaccatccatcgtcacaaggttacagtaatgagcaggctacttttacctttccctgtttttctaatctcttacgctgtcttcgtgctctactgttttcttttatctgcttcccctacatttagtagttttgcaagaatttggttgagtaaatgactcatgggaagaacacaaagcacttgttgacatttgctcgaacgtcaaaaagaaaaacctgagatggcgtccctgaattgtcaacctcttcgttttctccatgtttggtcgatgaatcctggatgttcatattaagaaacgaatagataaggtttttgacaggtcaaccatggtcacagggttatagagcaggcaaattttaccttttcctgtttttgtgatctcctaagctctctccgagctcttctgtttccttttatctgcttctcctacatttaggatatttgcaagactttggttaggactcattggactaacacaagcatttgatggcattgtcttaaatctcacctgagatggcgtctctggatcttcaacttcttcgttttctccatttttggtcaatgaatcctagacgtttatattgaaaacacgaatcaattaggtttccaacaaaccaaccatggtcacaatgcttcagtattgagcaagctacatttaccttttcctgtttttgagatctctttccctgtctttgtgatcttctgtttccttttttctccttctcctacatttaagatttgtgcaagaatttggttaggactcattgacaaaacaaaaagcactcgttggcaaattctctaatgtaacctgagatgctgtctctagatcgtcaacttcttcgtcatcagttctaatctttccttctttcactaatttctccatacgagcatgcttctgaaatgagtcaaacgacaaaaaatactatctcatcaactacaagactgatgaggaaaagctcaaaactaatcccgtgcttatcatctactacttgattccaaaaaggaccaaacactcaaatgctaattcaaagctacctaatttacctttgatgaaacatgtgcttgcattgtgttctcattcaagcaaacaacggttggacaatatctgcatttataaaccgatttggattgtatcatacaaccgagaatatagttctcttcctcttcttcgggtggttcttctaaaaaacgattcattgacatcttctccaatgtcccaccatagtcatcagcatcagagttatcatcaccatcatcaacatcagcgtcttcgccagcagctataacagagaataagcaaagattttaccaaaggttctctgagagtacaatcacaagagaactaaaagagataattgctcaattgaagaagcaaacctggggattcatcatctcctgaatcatcaccgtcctcggaaacttctgcaacagagtcttcttcttcagattgttctgattcttccgtctcaggatcagagtcagaagagaagcacgatgaatcggatccactgtctttatcaccatgctcaagcttgtaaaatcgtctctttatcatttttacttcgtgtttactctacagagacaaaacccaaatttagaattcgaaattctccaacaaatcaaaagtaaaggagcaaacttcggattaaagtaaatagaaaagaggagactttcgtaccgtgagttccgcagaagagagcttggagactgaaaaggggaaagctttgctaaagagaagggttttagggtttttaggttatttttgtaaattaagtaacttttataagggtgttttagtcattgagtggacaacattttatcccaataaatatacttattgagttgaagttaatcctctgcagttatttcattgtccatcaccaatcgccaaaaccgcagaaaggtctgacctttggattagcggtgagtaattagggtttatcatatcgaaatttctagggtttctttttcttacttcggatttcagcaagtttattgacccgaatctttgtttcaatagaatttttttgagttgtttaagtaagagttggagtttcgctttgatttttcgagtttgattttgtgggctaactatgtttatgcgtttttggtttcagtgagagtttcaca

SEQ ID NO: 168 - DNA, 3000 bp, Arabidopsis thaliana
caatccagttttaattaaatttaaaacatcgtgtgtgagttgacaaaatcaaattacaagctatcttgcagttttacgtattacctcttttaattaaacacaaggcaacaatgttttttcttatataaacaatttaccatctgaaataaacatactttaccaatcgacgagagatcacaagtataaggagagtactactccctctaatcatgcacccctaaaccataaaccacttacatcttcgaaatagttgaaattgaagaaagaaataagttgatatggtagaagtttatgagttattaactgtgatggtttcactcattgtggtgaagctatttcattggatatatcagtcgaagaatccgaaacctaatgaaaaactacctccagggtcgatgggttttccgatcattggagagacttttgagttcatgaagcctcatgacgcttttcagtttccaacattcatcaaggagagaatcatcaggttcatttggtaattttctctagcatgcagtaactcataacttacttaagtaacgttgtcttttttttcgatatggaaaaaataatagatatggaccaatttttcggacaagtttatttggagccaaagttataatctcgacggatattgaattaaatatggagatagcaaagacaaaccatgctcctggtctcacaaagagcatagcacaactctttggagaaaacaacttgttttttcagagcaaggagtctcataaacatgtccgaaacttgacattccagttgttaggttcacaaggtttgaaattgagtgtgatgcaagacatcgatctcttgactcgcacacacatggaagaaggagctaggagaggttgtcttgacgtcaaggaaatatcaagcaaggtaaagaaaagttatccatttcgtactcttgttgatattgcaatccactagatattggatgatctcaaatctttgtatatttaaacgttacagattttaattgaatgccttgcaaagaaagttaccggcgacatggaaccagaggcggcgaaagaactcgcactctgttggagatgttttccgagtggctggtttagattccctctcaatcttcctgggactggtgtttataaaatgatgaaagtaggtgtttttagtaaccttaattgtagtaatttttctacaaaattaatgatccaagccgtgaggatgatgtttcgttgcaggcaagaaagaggatgcttcacttactaaaggagacaatactgaagaagagagcatcaggagaggagttaggggagttcttcaagatcatctttgaaggagcggaaacaatgagcgtagacaatgcgatcgagtacatatacaccttatttctgcttgctaacgaaacaacaccacgtattcttgcagctacaataaagctcataagtgacaaccctaaagtcatgaaggagttgcatagagagcatgagggaattgtccggggtaagactgagaaggagaccagcataacatgggaagagtacaaatctatgacatttacccaaatggtgagtttaaatcaatataagattggctaatacatagtaagtagctcatagaaatatggttgtttgttttaggtgatcaatgagtcccttaggatcacaagcacggcgccaacagtatttagaatatttgatcatgagttccaagttggttcttataaaattccagctggttggatcttcatgggctatccaaacaatcatttcaatccaaaaacttacgatgaccctttagtattcaatccatggcgttgggaggtgaatgtcatatgatcttttacttatttactacaaatttagtaaacaaattcatagaaattttaaactaaatgtttagggaaaagacttgggcgcgatcgtctctcggacttacattccctttggtgctggctctagacaatgtgtaggagctgagtttgctaagctgcaaatggccatttttatccatcatttgtctagagacaggttcattttcattaactaatgattgtgattagattttatttttgcttgcagccaaagtttttacttacatgtaatataccttatatatggtttgaaggtggtcaatgaagataggaaccacaatacttcgaaactttgtactcatgtttccaaatggatgtgaggttcaattcttaaaagacactgaagtggataactcgagtggttcgaatcccgattgctgcaatggataaaaaccatcgatcttgttcttgaacgattattgcaaatgttaaatacttaaaagactagttggtaaagatgatttatcaaacgagtcatatgaggatttaagttttatgaaaaatttactggacttataagaattatgcttgtaataatgaaggataacatgcatatttttcctatgttgaacaaattgaaaatacattgttacctataaaaatggagattaaaagcaaacaaatcctcacctaaaacatgctttcttgacctctttaggctctggcaatttaacaagtagccgtttaggcctgtttagttttagacctgtttacatttttaagcttgcaagcttaggttggttcatatatgcccatttacattatattcaattaattggagaactttataccatggttttctctttctatggacatttttcaacccaatcaaaaaaaagaaaagtaaactgaaatctcttacttagaaaattgattctactatactatatccggttttaaatctggtccttgtttggtcttggggataataattagtggcgaaaacggcgtcgcttttgctttggttttgggttaaatgagtggtgtttgctaatgaatgggcctctacgccttttaacagcccatatttgatcacatttcaatctatcacatgattttaaccataataaagccgtagccatttcttcttcttcgttccttcagatttttcgcaacagagagagaagtcgaagcttcacgatcgtataata

SEQ ID NO: 169 - DNA, 3000 bp, Arabidopsis thaliana
gaaaaaagatctatgttttacttacagagacagattaaacctatccaaatgagaggaccaagttaatttgaaactaaagaaaaaaactacaatataataatgagatcagatgaaagtacctgtgactttgtgaagaggtgacgaaacgaagaagaagagaagaagacgacgagaacagaaaaacgaaagagcgatagcaattaatgcttctttgggtgtcttgtgaatatggatgttaatgtgaatgtgagctttttttgttggaaggtccaaaaaacaaatctctttcttccactggcccttttgcttctccatttatatttgtgttttacattcacatgtaatattatcatatatgcatacatttttttatttattatattttatacattttctttcaatgtacacattcttgccacgtgttcttctcgtaaagttttttgtttatgtttttatattcgcaaatataaagtttttctcgacatcgaaatttactaaatctaacgaatcatcatagtctctcatgtagtcctaccgtttcatacaagataataattaatgtcatggcctaattatttggctctgattgttttcggagggagacatgaattttttaggcacaagacaaaattttaaaattattgaaaacgatatatgaaggaaatcgttaggaatatcatcttctatatttgtattatttataacataaagaaaattatttttctttttctagtttaggtgaatcttggtacaatttggacatgaagtcaaaagttgatttcccatttaatctagaaccaacgcacaagaaaattaggtttcaactattacgtttaggggaactttttaagaaattatgacgaatgaaatcaaattaaatgtaaaaaaatatagaaactaaattagtttcttttctatttacaaaaacaaagtaaataattttagattggtaattatattaacagtctatactctatacttaccacaatggtaaaatatgaccaactacagttttaagttttgactaatttgtttgtagcgtcaaaagctggaacataactttttatttcctcagtgagtgacaactggtaaaacagatctaaaggtaaatagtgtttatctctataaaaaccagtccattcacatctctagtttaaccggcgagtaaaccaaaaaaccaacgtaaaccggtggcacatcgagcaacttattaacgtttggactttagacctccgggttttgtaaaccacagccagtcctgactacagctaaggtagttccttaccacatgtaactgacgtaaaaccaaaattaattagttgttaaacttttgtcgtgtgtttatttgatcaggattaataaactatgagaattgtcttacctcacaatccatcttcttaactgctatacgttattttattaagttatctttagagcgatgattacgtcctcataatctcattcattattcacgtacctatcaccgaatgataaaactgataccaaagttttaatgcaatcatatataattgcactaatttaaaaaattaaaataaaaacatataaatgcacttattttggtatttcttagtaagaaatataagatagtggtaacattttggaaacttctcgatcgcccaaaataaataaaattgcatctcatacaagtctaccacaaaacgttatgaaagtttgttagcggaatagagtctacatatactgtctacgatttgtaaccactaatcttaatctatgaaactattaaatcattgtactatgaaggaataatattaaattcggatgctaatcagcgagcactaaattattggattatgtaacaagtggtcttcgacgaatgaccagcatttttaaaggggattttgtatacgattgacaatgactcactgattaattaagcattcagcgcataattaattatttcatttctgataggtggcgaaaatcggcgattaatcataataatcaattagagagattttatttgtatagttttcatgatagtcacaattatgtaaataaaatcgagatattaattagtttgcgtaccgatgggttgtcgtcaggttagaactttgatcatcataaacaaagtatgaagcatcatcatcattctcatctccatctttttaaaataatttacgatttgaaattatgcactttgtctaatcgctgtctactgtctattactttcactatatcccaaatccaaatttatatatgaacaaaacttctttttcatttatttttagaaaaagtctttcagaaattttcctttatcgaaactgaatacgaatatattgtttttattggccgacttaaactatatgtaagctatagagtagtctgctcgtttaatcttgaaaactaagccgacagaaaatattgaaatctctggatagaaaattcttaactaaaataacaattataaaaaatgatacaatcaaaaccgcaaaaaccaagttttatgaactatatctgaatcttattgatcgttttttaaagataaataattattttgttgttgatgaaaaccacaaacttcgagtccctattaggctcccttaatataaaccataccggaagttcgaatctaaaccaagaatgtttatcaaaagtctagagacgtttatgcattaaatcgaatcgccgaccacattatttaaacgttactactatactatcatgagtttaataaatgcgacggtccatttaaaataacgggtccactattattatttgacacataaccacaaaatttattaggtccattatcaatgttgggcctatcgttagctgtcgtcaatagctggttcttaaattttgaggagtatgggtttcattgtcacatttcaaacatcatgcccaaattgatagatttcgtaaataatatggcaattttgataaaactagagaaaagaatatggataaaaagaaccgtttgaagaaatttatcttacgcggcggataagaggaaaaaag

SEQ ID NO: 170 - DNA, 3000 bp, Arabidopsis thaliana
atcagcatagatcatgctaaaatagattttacaataagttcaaaaaaagagaggaagaggcttcgatcagtatataaaaaagttgcaagaaaacgacaagacacaaaaaatcaagatgaacacgttctcacgttgtgctcagccttcgtgttctattgcgaaagtgaaaatgaagaaccttttgtgaactcaattttctgcaagtaagcaaagaatgtgagaaataaaatggacaaaaaagcgtgtggataagactcacacgtgcgtggggtcttggtgaaaaaaagaaagaaaaatcatcttcggtatcttccacctttttaatcttccatctccttaatttcagagaaaaagctacacttcacatgacatatttcagacggctttgatttttgattttttttttttttaatttttgttgattaaatattcatatgtttcaacaacaaaattcgtaacatccaagaaaaacaaaagaaacatgtaaatttaccacagatcctgtttctagagtagtaaaaattgatttgttcgaactagaacactagaaatttattttaaacgtaggttattaaaaaatcgaaaaataacaaatgatgggtacatgcatgacaggtttgtaattttatgcgttggagggtttctcatgaatgtgcatgaagatttgtaagcctatgcttgaatatatgtatacaaaaatatatgtcccttgtccattgtaagtctttttcgatacacatttgtctcgaaatgacattacgatgtcgatattgttcatcatccacatgctgcgtctgcttgtagttgccaatctctatcctgacctaatgtcgttcacattattattatcattaaaatttgtatagtatatagtaaaatttcgaacaatgaaattattaatataactgatttgaatactttagctcgaaacattgttttaacaaaattaaagatatgtaagtgttcattaattattggcttaatttaagttacatgtacatatatgtcttaccaactaaaaaatatatgtctagtcttacaaaaaaatgactaatgtttcaccaaaaaaaaatgactgatgcatgattatattcaccaaaaaaaaaagcaaacaatacctggtagtgagacggccagagaagaagcaatcacattaagggcactgagcgacctcaaaatgtaagcaagagattatcagagaatcttgatttagtgaaatcacattaataatttctgagacggccagagaagaagcaaagagagtatgtttattatttctcaacttgttttaaattcttttatctgggcttggcccaatatatttaaaccaatgatcgcatatgtttagaaattccaaatattgttagtgggccttcgttcagcctatcctaaaaacatatgtttgttgtagtaggtaacaacccaaatcctaaaaacataatacaacaacacccatggcttcctttggtcatcttctcgttaattattcaaatatccacagttttttggacgttaacaaaaaaaaaaaggcagtggaacatacaacgttattcgacaatcttgcacgtaatattacagtacaatccgattcaagacaaactcaaacttcgaaaagaaaattgcatagcttaatttaggaacttaattattacaacacgtcaacacattacaaatcgaaggcaaaccagcaactattttctgtttacaaatcacaactacaagttattgacaattttatcctggaatgataaaacaaaaaggagaatcgtactcattatttgtcacatgcacaaaaatatacatttcacaacaaaaagtagttaaaacaaaaacttaaaaatagataccacaattgtacatataatctcttgaaaatttgaacaatacgaattacaagaatcgaacattcatttaggtggaatatttaaagacgagaaaatggcagcaaatggacgagtgatcataatagcaatgctaatggtggctatggtaatgaacatgacatggtgtgtcaacagcaaaggctttgttaacttaggaattagtcctgaagaactacagagttgcatcaagacttgtattccggaacaatgcatgcccgaggctaataatctgaccgtgtgtgagaaagcatgtcacaaatattgcaaccgacctgctatgtcgttcaagcccaactatgtcgttcctgtagatggaaatgatgttgggtttataaaagctgctttttgcaagctatggtgtgaagaaaactaattctttctttttaatggtgctaaaatttaattaaacctcttcttatcaatgagctcaacatctattattttctttaattggatttggtgagttttaatatgtgacaaaatactgacttgtatatcctaatgttgagtgtgttttgtcatcatcgtattattgatgattttgtttagtttatgccaatatatatttatgttattggtcgtatccccagtgagaaggggtctaaaagtaatttggggatagttggggtaaatatgataagactaaacatataaagggtgtgaatgaaaataaactcttaaaaaaagaaagagtagctcaatggccgtccgatgaaggtttcagttacacgtgtaatacgatgaagcaaccgactcaatattgaaaaaggaaaaaggaaaaggcaaacacatcagtcggcggatagcgccgaccaataatcatcaacatcgttttctttcttcgccaaccaattttagctttttaattaattttttcatcttcttcttcttattcctctgataataagatccaagatcttgttttcttcttcgtatcgtcgcgaaactcgcgatttcttttttgtttttcttcttcgattttgagtttcttccgtttctgttttttatctgatcggaagattctagctttcttcttttttttgttctttagatagtttttttcttactcagaaaaaccattggagctctcgttaagagttttatagtgttataagcc

SEQ ID NO: 171 - DNA, 3000 bp, Arabidopsis thaliana
aaaaacaatggcctaaccttttttacagcttaagagttgtacagaagactaattctataagagtattttattatcaattcacattgtgcaaaaaggttactcttgaggcttcagataacagcttcttcttagccactctgcttgatcttagtagatgtaatatatatccttcacctgcaagtttcattaaaacctaactaagtcttgaaactagagacaatttataaacatctgaattcatcaacaacagtacttaaagaagcataccctgcatgaaaccatcccatatgtatcatatcaaaccgtaacagttccacaaatgtcaacagaagtcgtctttgctggtgtaagcacaaccgccactgattcgaccttcccccaaaatgtaccatcttcctttctttcccaagcaatctctatgcaccaaatctctcttttcctacagtcataccgcctaagccggtgcacatcagcgctcaaaatcaccaacttcccgccaaaattagccattttatatccatccacaaagagaccattagctggaaaaccttgtaaaccttgcaagtaaaaccaagtcttcttctctggatcatatatttttattggccatccaaggaaatacactgatgtattgatgcaaaacagcaaattatcaaccacacaagacgaatcattccaagaagcactcaacggtccatgagtccaagactcccatttactttccttaggatcataaatatgaatattgcgagtaagatccaaacagtaaatcttctccttcatcaccgcatatgtcagaaactctcctcttccaaacgcttcagggtacggacctggcacagaactccaactctgtttctttaaatcgaacacttcaacccaatcagatgttcgtaccttacgacctccgatcacataaatctttccgtcaattacacccgcggctgcgcgacagcgagccatcttcatactcgggagggagcgatactcgtgaaatctgcagtttatgtgagtcacatccgagatgcgtcgttcgcctgcgtgtccacctcttatggatgtctcgccgcggcgtccaccgcttatgggtttattatagcctacgcctacatcttctaaaagtttctcgccgacgcgtccaccaatgacatagatatccgatccgatagtgacgacagtagatccccaaggcatgggagggagggaatcgattttgcacaatttcaacgaaatcgtgttaggcaagtttcgatagggtttacgatggagaatgtaccagctagggttttcaacaggagggaatccaacgtaggcgtaaagaacgttttcggtgtagccgagacgcaagcgatcatcgtagagcttcgacatgagactatggaaggatctgcagacgagggaaagcgacgggtggtgacatctccgaacgagtaggaagcaacgtaagatgagttcttctggaattggtagcgacacctgaaccttttctttcaatttcttgtttcgatcctcttcttttttaggtttcttgatttgatgatcgccgccagtagagccgtcgtcggaagtttcagagattaaaaccatcaccgtgtgagttggtagcgaattaacggaaagtctaagtcaagattttttaaaaagaaatttatgtgtgaaaagaagccgttgtgtatatttatataatttagaaaatgtttcatcattttaattaaaaaattaataatttgtagaagaaagaagcattttttatacataaatcatttaccttctttactgtgtttttcttcacttacttcatttttacttttttacaaaaaagtgaaaagtaaattacgtaattggtaacataaattcactttaaatttgcatatgttttgttttcttcggaaactatatcgaaaagcaaacggaaagaacttcacaaaaaaccctagctaactaaagacgcatgtgttcttcttattcttcatatatcctctgtttcttgtgttctgttttgagtcttacattttcaatatctgactctgattactatatctaaaagggaacatgaagaacttgagaccatgttaaactgtacaatgccttcaaacatggctaactaaagatacattagatggctttacagtgtgtaatgcttattatctttaggttttttaaatcccttgtattaagttatttaccaaattatgttcttgtactgcttattggcttggttgttgtgtgctttgtaaacaacacctttggctttatttcatcctttgtaaacctactggtctttgttcagctcctcttggaagtgagtttgtatgcctggaacgggttttaatggagtgtttatcgacaaaaaaaaaatgtagcttttgaaatcacagagagtagttttatattcaaattacatgcatgcaactaagtagcaacaaagttgatatggccgagttggtctaaggcgccagattaaggttctggtccgaaagggcgtgggttcaaatcccactgtcaacattctctttttctcaaattaatatttttctgcctcaatggttcaggcccaattatactagactactatcgcgactaaaatagggactagccgaattgatccggcccagtatcagttgtgtatcaccacgttatttcaaatttcaaactaagggataaagatgtcatttgacatatgagatatttttttgctccactgagatatttttctttgtcccaagataaaatatcttttctcgcatcgtcgtctttccatttgcgcattaaaccaaaaagtgtcacgtgatatgtccccaaccactacgaattttaactacagatttaaccatggttaaaccagaattcacgtaaaccgactctaaacctagaaaatatctaaaccttggttaatatctcagcccccttataaataacgagacttcgtctacatcgttctacacatctcactgctcactactctcactgtaatcccttagatcttcttttcaaatttca

SEQ ID NO: 172 - DNA, 3000 bp, Arabidopsis thaliana
ttatagtctgtgtgtataaatatgatgagtttgaatatcacgggtgatgaaaaaaaaaaaaaatgaatatcacgggtcctcgaaaaccactccttctttatccccactgtttcatgttttcttcgcataggtaatgggttcaattgtgaaaaaaaaaaaaaaaggtaatgggttcaatatttcgtctatattaaaacttatacacacaactattttgccctaaatgaattgtgacggagagaattttacgctctaaactggaaaagatagagtgatcctgaaacgaataaacggaggagaaggggagagaaggagtatcatagtttagtttctctcacactgtatccgattatttaactccacgttgacacgttgtctctgacgcgtgagagacttgttgtcaaatgtaataaaccagctaataattagtctgtctcctggtacagtcatggttgcatgcatgatcatagtttggtttctcccacactatggatcaatttagtttacatagtgaagcaagtttatgttttcaatttcatgttgttactcaccttttctatttagttcaagtgaacatataactcatatcgtggaccaaattagatttcatagttagttcacatgatggaccaaacttagatgttaaaattttgtacatatcttaaaaactcaacggccttgaaatatgatgaagttcaatttgttttaagtacatagccgagacaagtttgattcatcttgtagataaaatactagaaaacgttaacaaattgtatatttgcttatcttttgcttatactctacttatgttttacataatttttgtttgtttatatttggccgaccacaaaaaccaaatctaattatggcctttaccggaactaatttttgtattggtttttattttattttattttattaatttggattgtaaaatccagtaacaattttactatttcaacgtaagtaatgtagagaaaaatctcttgcaaaaagaatttacttgttcgaaagtaaactatataactgctgacaaagacaaaaaaaaataaaaaataataagagagtggcttgtaatatagaagaaatataagggtagagggatggcaaaaaaaaaagctaggtaattcaccaggagaaaattttacatttttactaaagtattttatatgtttgaaatctattttaacaggtttccgatggagatcttgtcatttgcttccccaaacataaccaaccagcttttgcccatcctcgtttaatacatctcaagatacaggtttgtttctttactttttaaattttgtttctttactttttaaattttgttgctcgattacttatgattcctagaatgactggaactagcaagaaaagtgaatggcgaacatcagaggcacacgtcagtaccgccaaatgtcctgaaggtacagtgccaatacaaaacataaccgttttggatcatcgagcaaaaccagaaagaggcaataacaatactagtttcatcccctaacatgaggtacataaactactagtttcatcccctaacatgaggtacataaactgttaaacatatatctatcattgtacttctctctttggtaatacgtatttctctctttggtaaaaatgaatgtacttctcgatttttagttttgaagaaattaaatgcattattaattggtaagtgtttttttcccaaccgttttgtcaatatattattttcctaatatttgtgatgatagagtgattattttttacatatatagagattatattgagatttgttttttttttaaacacatctctagatttgttttaggtccataatagacttcgataaaaaaaaatcacaatttaattttatgaaaatacaaaattctgcacgagttgtaatactagtatgatataaatcacataccaataaaacctcaacattgttttgttttgtaactgatcactttgacaaaatgcaaatccgttaatgaaaaatttatgtgacttttgacttaaactatttttcaattaaatttatcggataataaatgtgagaatgtcagaaatagttagaataagtaaatgtgatgaattttatttattcagtttacatgttaaaaagtcattcagaaaacagcaaaagtatttaaaataaagtaacaactccaagttttacatttctgatttgcatcataagtgtatttgtgactttttaagtccgtcctagaatttgttcttacaagttgatcataataatgcgagagatgaatctatgagaaataaagttgagtatcagactaaattttctcatcgaatgttcaatgttgcatccttgttgaccttgtccccaactatcatatactactactatatttcaaaataagttccgacatattaagaccaaaataatagtggtttttctaacatgtaattaaagcccatattttaaatgttgattagggcccataatgttatagtatatactaataattaattatttgattatttaaattattataaattttttgatatacattacatatgaccataggacatatagataaattcctgtaaatattaacatattagatgtcaaaatatttttccttgtagagtttaaaacaaattatcagtgtccatcaaaagctggtttaggttcgtgtcaacggttgggccgaaaaaataaacgaatttcaaaaattatagactctaattaagtaggattacttattttgattgtaatcactacataaataaaataattaaatatccattttttctctctctctttctcagtttttttttttttgggtaagcgtttgctcgttgtgtaatttcccggcaacggaagagaggaggaggaagagtgtaagcaataaattcctcttcttctacgaaacatttgctcttctcctctttctcttctcttctcttctcctttgcttctccgattctcttccttttttttagtttgatccgactactcaagctttttttctgttc

SEQ ID NO: 173 - DNA, 3000 bp, Arabidopsis thaliana
ggtatctgtagaggtagaagacaaaggctacacccaaaaagagtataaattttttaatcttagaggtagctcgctgattgacccatctgcttgatctaggcatcgaggaaagaaaaaaaaaacacagttagtcttcttctctttggtgaacaagacgatctcagaagtcagaacagaacagaacaagcttgttgacttggatagtgtttgaagctttaatgggcttaacatgggccaaaatctagttgataagtttacgcctaatttaaagcccatctcagccttgagagatttaattgcaacttttctcttcaattttcatgacactctagaataataagtttactttcagatgagaaatctagacatcttcgaataacgattaacgaaaaatgatatcacaaaatcgtcaaaccatgctacatagtaaaagggactgctctatagtgtcccgactccaaacaaaaaaaaaaagtggataatgatattagtgagaagcggaagcaactttctcgcagttttctgattcagaatcatcttcagagaaacttggcggtttaggaatgaggcctaatgtcttgaacatgagctggtcagcgtcaaaatcattgtttggtgtggttaaaagcttctctccggtgaagatagagtttgcaccagcaaggaaacagagagcttgttcggacattgagaaccggactctaccagcagacagtctcaccatcgcttttggcattacaatacgtgcggttccaatcatcctgatcatctcccatatctcaactggctgcaaaaacacaaacggttctcaaagccatttcctactaagtagctgctatgacttgcaatttgtgattttagattgtggagatataccttctggtcttcaagaggagtgcctttcactgcaagtagagcattaatgggaacactctcagggtgagaaggaagtgttgccagcgtgtgtaataaacctattctgtcttcctctgcctcaccaagccctatgattcctcctgtttatcggtaaaagaaaacacttgagaacatgtcgtatctatggatttatcaaaatcaacgaatattacaaaactgtgagtctaatgaccaagctgaagacaggtttcaatcctttagttctatagaattgaggcatacaagaatactattttcatatcaaagttacctgaacaaacgttgattccagcatcacgaacatggctaagagtttcaaggcgatcgtcataacttctagtagtgatgacgtttgggtagtactctcttgaagtatcaagattgtggttataagcagtgaggccagccttctttagctctagtgcttgttgtttctcaatcatgcctaaggtgcagcaaacttccatccccatgcctctgttttaaagtgagagcccagaaagttagtaaacacattcagccagacaccatcatcaacatcatattcattctgctcacggatacatcaagtacactttgaaattttcactttagtttgacatgcaaaaatgttcattctagaaccattaatgatcggttcggtgggttatcttttaagttagcttagattcagaagcagctgaaaaagggatcatataatgtagtataaacaaggaaattcaaagttcaacttaaaaagcataatagtaaggtaccttatttctttgatgtattcaagaatctggctgaagttggttttccgtccaattgtatctcgccaagcagcacccatgcaaaaacgtgtgctcccagcttcttttgcctaacaacacatcaaatttgttaattcaaatcagaagagctcattacatcgtcaaaatgcttcattaaacaattagagtcttttggatagagatagagctcggattgataaaaacaacgttttggtacatagtaatgcatgtccccttcttcttgatacattctgctaaggattctacattcagcaaaaataaacattcacaagaaaagtgcaaaccttcttagcagcatcaatgacagcgtccttagacatgagtctttgtgccttaactccagtgctatatctcgaagactgaggacaatatgaacagtcttcactacagccaccagtctttatggagaggagggtacattgttgtacctccctgaagttatgaacatgtctatgaacctgagcctgaaacccaaagagtccacacaccatcgttattcaagtaaaagacaactgataacgagatcagatgagcaaccaaatgaataatacctagctcaatagacattacaaagacactaaaatccgggaaattaagacaaatgtttcaaagagaacaaacatgttctgggttaaactaaaaatcgatactttccaccaataatttaacagaaacccaaagctttctacttcaaatttgtgatttagagtagctagaacaacaaagagaagagtaagtgagagagagagagagagagagagagagagaagaagaagggtaaattactccatggaagaggaggtcaagaagaggagaatcataaacagacttgatttcatctctactccaatcgtttctgggaccttctctgatagtcctctcagcttcagctgaagcagcagataatgaagaatagcaagaagcagattgcagaccacccgagacagagggtcgcaactgagatcgaaatacagatcgaacaagcatcatttgatctgctaatcagaaaatgtggaaaaagaagaagaagaagaaatgagatttggtgtttggtttgtgctagagcttttcactcttcagtgagtgattcacctaacccaaagcagccaccgttggagtttccgccttcgtgtgggacctacgagaatatcatatatctttaactgggctgtaataagcccaatttatatgttgggctttttaatagtaatcaattcaaacgacgacgttattctttatttccttaaacagccggagccgccgtgagagagagagagtcgggggagaagaa

SEQ ID NO: 174 - DNA, 3000 bp, Arabidopsis thaliana
atgcaaaggtcttactattagttcatcccattgttgcgtttttgcgtctacgtttattatcttattatacctggtagtattccttgagcttgatgcattcttagttttccttttttggaggaatgactgtcttagtttttaaaatttcagtttatactcgggagtggtgaaaatatctctgatttcacttactcggagaacgtttctcatgcacatatttgcgccgttaaagcattagattcacagatggagtttgtggctggaaaggtaacctctttgagtcaaagtgtatttgccaaatcactcctgaaagcgcatgaactttatatgtgatgaatttttactgtgccgactttatgtaggaattttttatcacaaacctcaagccggtcagattttgggactttgtaagccatatagttgaaggtctgggatacccaaggtaaataagcatccgaacagtttttgatacaatgaaacttgctgtgaactccttttatctttctgtttcctgattatcaatgtagcatgggaaaaaggctcctcagaacttctgaacctaccttgaatgttcccttcttaaagcaaaagatcttaattttctgttgatagatgtcctggagacatgtctagaagaaccgtttcgagaacagccatattcaattagtttttttagatataaactatctatacatggtgattcgctgatatttagtattttatacatggtcgtatatgtttccttctcctatgtcttaaatattgatcattttgaaaagttttagatccttagagctaactttctggtttacctgttttgatatttttttttcctctttaattgcagaccatccattaaacttcctgttcggctggttttgtatgttttctcacttcttaagtggacacatgaaaaggagggccttgggagtaattatgacacagcacatcagtatgctctgttagcttcatcaacgagaacttttaactgcaatgcagctaagaagcatcttggttacacacctgttgtgacacttgaagtgagtttgttggatagtattttggctttttgcatattcagctgcttagtaccttccttggatttattagctcttgttggatttgtaggatggtattgcatcaacgcttcaatggttctctcgggatcttgagaagtctgatgacacaatcattcaatctactgcagatcagcttcttggttgtgggaaaggttagaaccatctcgctattaacaattataatgcctttttgaagtgttcttggctaagtattcagttgtattgcttgaagtccgcatctcatctagctatggatatgatgatgcatgttcacaaggcttaacctggaaagaatctatctctattttcaacttagatttgtttgcttctagatgtctagaacatgctgaagtatctgcttggttaatttacatcttcttccagtccatgtaatttcatgcgagttccaactttatttcatgcacatataaacaaactcaaagcgaatctggtcaatgcaagcttttaatattaatctctttaaactgacttagcttttcatctctatgttctcatgcagttgcagacatcttgctgtggagaaatgagaagaaaaccttcgtttcttttcttgtcctaaacttgttttattactggttcttcttttctggaaacacatttacttcatctgcagcccaacttctgtttatatttgctgttgctctctatggagtctcttttgtgccgtcaaagatgtaagtattggttccagaactttaccattatagaaggcagtgaaaataagttgtgataccaaaattgtcctatcaaaggatgatgcacccatgtatatatatttcacctttgaaatctatatgcaactaagtgacagattgatttattttgacagtttcgggtttcaagtcaacaaaatacccccatggagatttgagatctccgaatccgctgtgagagatcttagtagtgatatcgtagttgtctggaatcaaggagttcgcagttttaaatccttaagcagtggaggagactggatcaagttcttcaaggtacaattctactctttatgctcaccaaacatgaaaaatatctcattgctctcgtttcctaaaacaaaacataaaaacagattgcaggatcactgtatctcctcaaactgattgtatcccgttcattggcagcatttcttttcacaggtactcgaacaaagcttttgttttcacacttcataaacatgattaacaacttcataaacatgattaacaacttctttatccataacattttctctacgctttgcttggacagttatgtcgttctcattcaccggtttcttcatctacgagcaatacgagcttgagctctaccacctagcccggatattcgtcgaatgcttaacatttattaaaaggatggtgatacctgtttctgatgcttcatctaaaccaatgttcatgtgaagcttccaaagtcctccactaaacgaacaccaacaatcccagagactaattgcagttattagatgtcttatgtacaaacattatgctatcaggatgtaatcttcactgagaggggatggatatatgattatttacgaatttgccataactactatcaaaatgcaccgttttgatccggtttccaaaaaaaaaagaaaaaaaaggaaagtatccttatatatcctttaaaagccgccgcttcgatattccctggcctctctttctctcacaatctaatcttcttcgtcttcaaactcaatctagggttctcttctcctctctgtaggtaggattttgaacacccaaatctctcatcgaatttttcttgctcaacgtatcatcgcacaattcgtctctcgttttccgtcacgtggataatcgaaatctcataatcccaaaggtaaaacaatcaattctgggattggaattttggatccataggatcgtcaattgaaacaatcccg

SEQ ID NO: 175 - DNA, 3000 bp, Arabidopsis thaliana
tattagcaggcctagctttgagaacattgctaaaaaggttgagacttgagattatctttccttttacttttaatttcactgtaatttaactttacaacactgatctcatgtgcatatggatcggttttctttcgcagtgggtacccgagctgagacattatgccccgactgtgcctattgttcttgtgggaaccaaatcaggttgaagataatgaaccactctgttatgtcttgaatgttaggaatctaacatcaatgtgtaagtgatgttatgtagtatataagatgaatttcttgatattgcagatctaagagacaacatgcagttcccaaagaattatccaggtgcttgcacaatcttcccagaacaggtatgtttttttaaagattcttcttcaatgtatatgatcaagaaccatgttaagaatcaaactcttttataactcaaagattgcttcttttatagggtcaagaactaagaaaggaaataggagcattagcatacatagagtgcagctcaaaagcacaaatggtaaagtaaccattaatgcttgagttacattttacaattagaccaaatattttggacctcaatctgataaagaaagacttatgatgatgctaaatttgcagaacgtaaaagccgtgtttgatgaagcgatcaaagtagttttacatcctccttcaaagactaagaagcgaaagagaaagatcggtttatgccatgttctttgactagtgtactcaagtctctggctttggtttgttttacatcttttttagtgtgtttcttctatgaaggactcttgcagattttagtatgattagctatcttcgttataaaagtttgatcttgtagtagagattcttgtaacagaattataagcgaattctcgtctatcagtctatgtaaaagaacaatgtttgtcttctttgagttcaagagacaacaacaaagaaccgttttagcgcaaaaagaaacaaaataaaccgattgaaacagaatcgaagaataaataaaccgggttttgttttttggctaataaccgaaaccgaaatagaataaatcaataaaatctcaattctctagtcttctcctttaaactagagtcgatgtctagctccaacgaaccaccgcgaaaaaccgaccaaccatcgtcgtcatcggcatcggcatcggcatcgccgtcattgtttttgtcactgccactggaaatcatttcgatgatcttagcccgcgtcccaaaacgatattacccaatcctctgctccgtctccaagaacatgcggagtcttgttcgctcgcctgaaattcacaaggctcgatctttactcggaaaagattatctctatatcggcttcatcgacgaaaattatcgccccgtatacgactactggtacactctccggagaatcgagaacagtacgaccgagaatctcttcgaatccattgagttcccttatccttccgagcctaatcgattttccatgaacgccgttggtccaaagatcttcttcatttcagaatcttgtactccttcatcaagactttcgatctttgacacccgatttggggagttgcgtcaaggaccttgtttgctagtgaagcgagggtacaattgcgtaggactagtcggcggtaaggtctatgtgatcggaggctatcaggacgacgagattgcagcggaaagctttgatctaaatacgcaaacttgggaagcagcgccgattcccgatgaaaaagaaagtcacaggtggatttgtaaagcaaatgtttcatttgacaggaaggtttgtgctttaagatctcgtgaaggcatgacttgttatgacactagagatggttcttgtcagagatctgagatgcctaatgatcaatggtctagagtaggattgtgcgtgattgacaatgtgctctttgtttacttctctagattcgggttaatgtggtatgactctaaactgatgctgtggagagtggtttatggttttgatcttgacaacgctcgatcagttggaatcggggaatactacggaaagttggcgtttatatgggaaaaaccaagtcttaatgttagtgaaagcaaagagatttggtgtagaatgattggtttgcttaggagtgaagtaggaattcatggagctgcagaaccgtctcaacttgtcgagattgtccctaacggttatagaatgtgtcattgtctgtctctttcaggttaaaacatgtctagtactactttctttggtgtaaaatgattgttttggataggagtgaagtaggaattcatgtgactaaagatgatgatgtttaatactttcgttagtctatatcaatacaatgtgttacaagattatgaatgtgttgcggcgtttacgtcttcaactctcgatttattcaattaatgttgcagtttcagcatcttcctctgttccacctaatcaagtttgtgttattgtaaactcactcagttaagtgtattttacatcggagttgttgtgttgtgtttctcttgcccattaaaccgattccatcgaaaactgtattcttaaaccgaataatgcaaatataaattataaaccaagacgaaaccaaaaaaagataaccgaaaatgaatgaaaaccggactgaacatcggtaatacaattagtcaaccaacacacttgaaactccatacgagtaaaggcccattggggatgaggatatttgggccaatccttcttaccgtttttcgtttgttaacaattaccgaattaaaagcttgatcgccacgtctttttcttaatagaatatattgattttatttatcttttatttttagaccaagctcaggctatcatctctccgttaattagggttttcttctctatctcgatttcaataccattgttgatccgctgagctagggttgttcgatcccgataattgtgtcgcttagctctgatctctgttcatcgaatttggttaatttgttttgattggttaagatacattggaaagcg

SEQ ID NO: 176 - DNA, 3000 bp, Arabidopsis thaliana
ttttgtaccaaaaataaaaataaaaaatcatgttgctttgtttcctcgtttaagttgactttacaagttcgtcttgtcacgatagttgaaaactaatctgcaacgaagaatatttcggttgccgtatcaaatgcaacatgtatcgcgttaccaatagattacgctgttaatcttccttatgcgtaaagataaataattaactcgacacctaacttatattaattgagaactataaagactatgcaacatattttgtggtagataagaccataatattctctcagtttttttttttttgtagataaacgtataatttttggtttatagaaattagaatagtaatagaagatttatcctaactctaatatttttccttggtaattaagttccgaatgtaaatgctttattaattactatttatctaaaattagtaaatatataattttttagaatttttttcagccaaagtatcaaaaaaatctctataaatctaatgaatattttatcttcttctaataataatattttttgccatgtggattattagctttaaaagaaaatcttccaaatcagcaatcaaagaacttgtcaaacaactaaatcgccgttacctagatttataaaaatcacccctttgattgctgagtgacctcgtccccgtcacgccttttttcttaaagaataatttaagaaaaaaataataatatctcgtcgtccttttaggctttctccgattgttcttaatattcctccaaactttctctcaatctccgtcaaaataatcactctctctttgttttttctcacaattctccgaacatgcgtttgctttctttattctctaataaacctagtaaactcttcttcttcgttactactatataatatagcggagagttttggaaccagagagaggttttacgtttttcttattttatttctctccatggggattctttgggattcgtttctcttgttacttgtgtcaacgtttgctctgttcttagttaggatcctgttattcaaaactggattgatttacatggtcaagttatggcgtaggaagatcatcgactggtttcatgtttaccaattctacaaagtcccagaattcaacgacaacgttcaagagaatcatctctaccaaaaagtctacatgtatctaaattccttaagctcgatcgagaattctgatttcacgaacctcttcaccgggaaaaagtccaacgaaatcatcctccggttagatcggaaccaagtcgttggcgacgagtttctcggcgctagagtttgttggattaacggagaagacgaagatggagcgaggaatttcgttttgaagattcgtaaagctgacaaacggagaattctcggttcttatctccagcatatacatacagtatctgatgagcttgaacagaggaacacagagcttaagcttttcatcaacgtcggaatcgatgatcatctgaataagaagaagaagaagaacggacggtggagatcgattccgtttgatcatccttgtaccttcgacaacatcgccatggaaacggatctgaagaacaaagtcaaatctgatctcgaatctttcctcaaaggtaaacagtattataatcgtctgggccgtgtttggaaacggagttatctcttatacggaccttccggtaccggaaaatcaagcttcgtcgcagcaatggcgaatttcttagattacgatgtttacgatatagatctctccaaagtagttgatgattcagatcttaagatgcttctgttacaaaccagaggcaaatcagtgatcgtgatcgaagatctagatcgacacctctcgacgaaatcaacggctgtgaatttatctgggattttgaatttcactgatagtattctcagctcttgcaccgccgatgaacggatcatggtgtttacgatgactgggaaagaacaaattgacccggctatgcttcgaccgggtcgggtcgacgtacacattcattttcccttatgtgatttcacggcgtttaaaacgctcgctaataactacttaggtgttaaagagcacaagcttttctctcaagttgaaggaatatttcaaaacggtgcgtctttgagtcccgccgagatcggagagttgatgatcgcgaatcgtaactcgccgactcgtgcattgaagcatgtcatcaatgctttgcagactgatggtgatcggagaggaactggacgacgtttgcttttagaaaatggttcgagaaagtcgacgtcggaggatgtttctgatgatatgagtggttcgctttgcggcggtggcggaggaagttcgccggcggtgaaggagtttaggaagttgtatgggttgttgagaattaaaagtagtagaaaatctggatcgttcgatgtggctcgagagatgagggacggctagtgattaaaaagtttttaaaagtcagcagccacgtgggttggttttattggttgagagagagtctggacaaaaagcgtagactagagaaagttgttactctgtttttattgtttttgggttttagttgatgtacagaagtttataagattttgcttttgagtccccaaagtatgagattctgagttttgagcactttgtaattgaacattttgggccggttgtaaaacaaaagcccatagcgttaagcggattaataattttaacggaatgacaaatatgcccttcatggtaacagcgtcaataacacgcttttcggttcatcattataagattttgtgtcattaatacgaagctccgtcttcttcgccgagcgtcgtcgtcgtcttctagggtttatctttctcgtcgtcgtctcttcagattcttcaaggtaaattgaatatctccctcagaagatgaagatttatcgaatcatcaaagatactttgcgagctcttcgagtataaatgttctgatctttgttgtctttgtttatgttgatcacaattggtgttaggaattcgattgcttttgcaaga

SEQ ID NO: 177 - DNA, 3000 bp, Arabidopsis thaliana
tcgtttcacattttagttagctttttgtagaaactccacaatagtaaatgctgttagatggcggtgaagaagtggaagctggcactataatgggaaaagcaaatcagacacagaggattaatgatatttggagtaacttagagcaaaaagtcttaatgattcataaaccctgattatagaaggaaaaaaaagggaaaatgcaaagtagttgcaagtaattaattggttgtcaatgatgtcattagcttagacttgttgtttattcaattagtcattgctctgcaaatggtataattctccctgtggaagcaacaatagttttatggtaacacatttttacactaatagtcactgtctctaaagtatcagaaaactatgaccgcggtaaacactgagtttcaaccattgtaaaaatttggaacccttataaatgaagagaggaaacactaatgtggtgggagcaagaagaaaggaggtgaaaaacctttccttgtctggttcctttaccatttaatgaaagtcccactggctgctccactgttcttggtgtcaattcatcacaaaatctattttttcacaaagataaactaacatagacaatgaatgatgaaaagtatacagaaacttaaccatcaaaatagcgacttgatgaggtaaaaaccactatttggttaccctttaactagtagcataccacaaaaggtaaaatttgaccataatcagaattgtataatttgttacttactgaccattatgcaaaattttagtggcatacatggtttggatagtttacaggtgatcaaatgttgtcgacaaaggtaactttggctgccaagaaaggtagacgagtaatggcggtgacggtgacattaaagagattttaccagaccaaacaaagaaaagagtatcctagtgtgtgccatggtagcaaagaaaggatttattgaggtgggctccaagcttctaggaagagaagaaagtatcttcatcaacacaaagataaaccataagacaaaatcataaggcccaacgaattgtaccaataaaaacaaaattgaattttggaaaaactaaatcatactggctgcaaaagatgtaaaggacaatggggacacctctttaattgtcttggctgatttcatcttttatggtccaaacagtgctcaataaacttcatagatgatgatgttgccacttgtcaaaatcacatccatccacgtaacgtagctgagattgagtgagctaagaagaggggccaaagcttttaaagtcaactgataaccatttgcttttcttcatcatcagtttttggaccagaaattatagtttcttaaattctcacatcaatgctccaagtcttttgcttctgtgtgtgctcgttctaccgaatagaacaacaagtcagtcacacgcatggaaaaaacagtaaacaacaagtacatgcatgaatgcttcaagtctttttcctcgaaactgtttcgtagaaaaacaatgtaaaacacttttaagttcgcttagtaattactgaactcaagacatacaaacgcagagactgtaatctgtcactggatctagacatttcttgtccattgacctaagccagaagatgatttaacatcgcaaaaagcaagtcaaacttgcttgttctcaatcaaaacatctctcagtaagttatggtccaacctttttcattcactatcttcatcaacaagacatgaccaaatcatccaactaaaagtcaacaaagaggaaggaagcaaacaagacaactttcatcttaatcacagtagaccaagcataagcaattactattagccaacttaaggcaagaaacaagccacgcaagtgatagaaagaaactgcaacaaacttagtacagtgttaaagcctagttaatgatagaattaaaattgtattaatggattagtaatttagtagtcccttcacaaacagtacacactattgagaccctctcgacaaagacaacaagtaatattaagattggaagtaaggatatgagatttaactgatagttagttcatgtaggacctctaacttgtgacctttgaagtcccgattctctgtgatcacatgaaaagtgttttgcttttttggggtttaatgatagtatttctctgaaggggtcaacaatagaaaatcttggcaaataaaacaatttgacttaattatttttataacaaatacatgaatgtcaaaatttaaactttatttaaatatcggaaataacaatttttaaattttaagatagaaattagaaactacaatgctaaatctatacaacaatggaaacaaattgaatttgtgaattctgtaacgatcaaataactagatcaaatgacaagatctaaactctgattagtgtttccatcatttataaatttagtattaaaattattttttaaagttaaaattgaaacgaattttttagaaaaacttgaattaaaaatgaaaaatgttttcaaatctgtaggaatgaaaacaaaaccatttaaaaaaaaaaacttaaagaaaccataataaagaggagatggaaatttgacttggatgcacttagagagaggatgggcgagagggcattattggacagttaattcatgggctttatcaattgtgggctttgaatgatttggatccaaattctaatgtacgttataggcccaaaacaaatcaccctcggcgttttctagtaatatacgttataaggcccttttatttaggtcttttttgtttttcattttttaatatacttccttgtatagacacttggactagtagttacggccttagaagattaagggtcaaatatggagaagatacaaattgtaggggtgattagcaaatattcgtgatattttagctgtatggttttggttccgatcacaaagagcatcgaatcgagctacttcctccgccggctttgctgtgtgtgtgatcgttcgtttactaaatctgaaacaagtatctaacgccttgccggag

SEQ ID NO: 178 - DNA, 3000 bp, Arabidopsis thaliana
tcgagtttagctgtttaggcattgacctcagaaacaacccgacgttttaggcagctttttctcccatagttagctacgtttctccatttttcaagattactaattttattaaaatattactataataaatagatttttatttacattttccataatctgaatgaaatcaaatatatgcaaatatcaaaagtatcacctgatcaccaattcctagttttgtccaatgatactgatgattcatcagccgattgattgaaggaacaaatttgaagttttccactgctagttgaattatggttagttcatttgacttatcaaaatcaaatgactaaaatattcgaattttcttacatgctgtagagattaatttcaattttaattcatcatcccattatctatataagaaaaaagtagaaacatttcgcgaaatacaatccaccttctgggttgttgtcttgttgaatatggtcaggaaaataagaccattaaagcttcaacctccaagccaaagagcaaataaaatactactgattaacgcaaaaacatggaaaaaaaataaagtctgcaaattggcatgttgacatgttgtacgcgtagctttacaacctcacaggtcgttttttttgtgtgacagttttaacccccaaaatctctttctttttgtttttccctaaagtaaaaaataaaaatctaacatgtccgaagtcgaaccaaacataaacatacaggtgttcgaaactagttaacacaataacacctctagatatatatatgattatggtattacttttctttggtgatttttttgttgggagagaaacataaataaacaagttggcccatattccagcgattttcctcacccttctttgatatctcagtttataaaagtcatgatactaataaattagagtatactcaaagaaaaatcagaaaatacacccaaaaaagcaaaaatgtgagaaagagaaacatgttgttgtccgctgtatggcgtcataagccattctagaatcattgaaatgcatatttaatcctctctggtaattccaaaaaagcgatgagggtattaacgtaaatccaccagaagacgagaaagtggggatggtggaaggagagatgataagagagatggaaacgcgtctctctatgaggcccatattccattcttacctctctctacctctctatctctctctcctcataatcgatccgtaaactcgccggaggagcagggagattcaataagacgatggctcagagaacggagaaggaagagaccgagttcaaagttctcgaaaccttgacgacaacaacaacgacgttatgtaccaataactgcggcgttacagcgaatcctgcgacgaacaacatgtgtcagaaatgtttcaacgcatctctcgtctcggcggccgcaggtgttgttgaatcaggttcgatcttgaagagatcggctagatctgtcaatcttcgttcgtcaccagctaaagtcgtgattcgtccaagagagatcgatgcggtgaagaagagagatcaacagatcgtaaaccgatgttctggttgtcggaagaaagttgggttgaccggattcaggtgccgatgcggtgagcttttctgctcagagcaccgttactccgatcgtcatgattgtagctacgactacaaaaccgctggtcgtgaggcgatcgctagagaaaatccggtggtcaaggctgcgaaaatggtcaaagtttaaaaaattaaaaattcgatctcaaccgttgaaaaacttgtggtggttcaaaagctccgatcggaagagagattggtcggagagacatggatttgatttggtgatgtgttgtaaaagaagatcagagagattattcctctcctcaaatcaaaatctgaacctcaatttttttttttacgtttttttttcatcttttaatttatatattagtgaatgattattaatattattattgtgtggcttacggattcatgaatttgcttcttgatcatcgagaaatggtgtatgtaagagacgaaggggttgtttggtaatttaggaacatgtctttctggtttcgtttcgtttcgtgtggtagatgtacttatcacgatactactagtccattgtgcgtcacaactcacaaagccaatttctatcagacaagtttgcttggcgtataaaatagcaaagccaataacgtgtttgagtttgtatgggttatcatcttcttgtgttccattatttttatagatttgtatattttaaagcataacatattaaactatacattagacttttgttttcttttaataatattaacatgagcttactcattctacgagttttttatgtgaattattttcaacgcatacaaaaatatcttgcatatatcttaaaagtccaacaaaatactgttctttcatgcaactatcattgtagccagactatagttatatctacttaataaaatgtgtaaaaaagtaagttcattgggacaattttcaattgtcatctaaaaattgcaacaaaatactgtactttcatgcaactatgattatttataactctagtcagaaaaaaaaaactgacggaaaaaaaaaaagtcagaaaaaaaaactaaaagttggagcacctaattaggcccaacccaatagtgaaaatataaatgtgttgttttaaattgaaacacaaaacgcaccgtttataattaaaagaaattcagagaggcttttcatatctaatttgttccgtcccttagacattaatcaggatttcaatcgtctgggttgctgctttctggatttctccgacagaaacccaaaccctagtaccaccaccttgaagctccttaattctatccgttctcgaattgaatcgtgcataggttagggttttagtggcgtgtatatatatattccaatttgttgattccttgggctctctcattgcggtggcaacaagttaaggtctttgataataatctcgtaaaggaattttcagtgaag

SEQ ID NO: 179 - DNA, 3000 bp, Arabidopsis thaliana
cggcatataataaggggggaaatatggaccataagggaaatagttaagagagtattgttgcctataaaggtgcattgcctgttgagcggctgctaaggaatactgatcaggataggagataggtggagcatcacactttgcagcctgcaattatcaacaaaatataaaagacagtgattaagcattgtgttcatatttcctggctagaaaaaccacgcggttggcctgatgctgacaatgaatgcacaagactaaaaagacattgtgtggggcttcttgataataaccaacctgatgagtgtctgtgattggtaaaacctcgttctttactttatctccttctgaaccttcttcagggagaacagtttgatctggctgcaatgttaactcgttctgagctgctgaatttgaaatctcatgattcttatcctgagaaaaagttgatatatctttcctgcaaaccaagtttcatataaaggtattcatatcagaaactcattcatctgagactctagatcaattcatgagaatattgaagcaagtaacactgtaagatttactcaaagtagctattagtcaccaacctagctgatgcggctgtcccatgagaagactcaatattggagtcatcacacccaatagtaaacttgtcagaagatgcctctctcacaaaattagaatcgaagctcccaaatgtcagaccattttccagcattttggcaacctgaatgtggacaggaaatgttacgtgcggccgttcaccaacatccgacttgagaagcgactcattcttgcatttactggctgcaacctcactcttaatgactgttccaaataaagccatacgtcgaatcacataagaggctgtaatcaaactcaggaacaacttaacagaatacagaatgcacttaaagcaacattagcaggcaagtaattatatggtataatttatacctcgctcggactgttgtgggatctgaaaagtttcaactacagcatattgagtatcgttttctacaacagaatctgatacagccactgatacactactttctttagacttatccggctcaacaacatccttagaagaagaagtagccttggagagaggctgttcctctgtgtccaccttgtccacaggggatatgatagcatcttgaattttctggttactgattccacttggaagacttatagggttcggggccctgaaaaagaatagaatgcgttaggaagcccatatccaaagagggaattaaagacatagacagaattaaaagtatggatacattatggaagaaggttttgtgtcgtttcttgcattgttaggagcagacgaagcagttccagaacctcctattatgtgattagctccactctgctttttaaaagctgcacttcttccattactggcatctgaatcaacaaagagcttgaatcaaggaaggaaatatagaacacaagtttagaagtaaaagaacataaaccacaatgacctgtgtaacttgaagcaaagttcttccgtccagtccggccccttccttgtgtatttggcactaaattctacaacaggtaatacacataaaggcataagagaaacgagatgatgtaagctaaacagagaactcaagaccacacttaaaatgcaaagtaaggattcaaaagaacataggaaagctacctctttctttctctcccgtttgcttctcacctcatgaaatgtatctgaaagatcagtaataatatatgagtacatgtctgctatcaaagtacatgattatgttgatcttgaaacagtagacagaatcaaaacttaacccagatgcccaatctcaatcaaagctaaacagaaattccctttccacattccagctagattggtaaagatttaaaacgacagtttcttagtcatgaacccaaattctacatattccatttcagtaaaaaagattccttatttgaacatccccagacatattataccaattagaaatctaaataaacaaaacataagattctaagcataacacacagattctaagacaagaccaaaatcgacaaagggcattaaatagcaaaatccaaaacaaaaccctaggagaagcacacgctcaatacaacaaaaaggaagtaaaaacactaaaacaaaaacaaatgctgaagctttctcagtaaaacaacctaaatagagaagcttctgagtggtctcatgtggatcactgaaacactccttaaagacagagaagatatcctcgtcggaatgttgtttaccggtaacctctctgatgttttgaatggtttgaagcagatcagccggaatagaaaccctagagccgccatcgccgctgatcctgctcatgttggttacagagagaaagagaagcggagggaggaggagagaggaaatatgggttgaacataaagacttcgtatatagtactattatttatttccgtacaatctaccgcttaatgtctctctctacgtatatttatacgctgacgtcactgtttatcaatttcctcctcattatttgattgagtactattatttatttccgtacaatctaccgcttaatgtctctctctacgtatatttatacgctgacgtcactgtttatcgatttcctcctcattatttgattgttttgtacgcgtttaatggaaggagagacaacaaagttgatatggccgagttggtctaaggcgccagattaaggttctggtccgaaagggcgtgggttcaaatcccactgtcaacaatttactttttttttttttgtctttttacaagaataggaaaaatagacagctgtgtaaaaaaatattaactttgttttgtttccacaagtcgatgtccaaatttaagaatatatatatattacacgatttagctatctcctctaattagatgaagagacatcagatcttatcaaaaccctagctttcggtgtctctctcgatcctttagctcaatcgaaaactgaatttaggagctgcg

SEQ ID NO: 180 - DNA, 3000 bp, Arabidopsis thaliana
taatttctaatttttcaaatttcatttttctcagtattaatgcattaactaaaaatactataatttagtattgttatattaaccttaataaatattaattaaactaataatgtaacttaataaataggtatttattattatatgatttctaacataacaaaaaaaagggaaaataacaatatagaaaattagaaactatttatcattatccattatttgatcaaactggcactagtatatcgattatttgagccaaacatatatcaattattttgttcaaaaagtctaactaattgaagaggtaaggttgtataaggaaattttggtatagaaaatagacaaataatatatcgaagaaaagtgtgctaagtgtcttttggcttgtggggtattttgggtgcgccttcgtgcgaaattccattaggccacctttcttatttcacatatatttacacatttttgtcatgattatacaggatacatgcatgcccatatatatcatgtaaagatatgcatgagaagacatgtacttgtatacaaatgtgtgtacacatgccaatacgtagctatagttgtgacttgtgaaaatcagttgattattctattttagatgtcgtcgaatcaaatgaccttttgaaattcggtataattagatatctacaacaatatatagtgtagtaattaatggctacgatactatatatacgtacgcggatcagaacggtttcttgggactttgaaaaaatatggtttgcttttgatttggttggtatgagaacagaaattagttagccaaaatgtattttgttctattttatttggaaataaaccaaaactaagtctatagaattgaggctgacccgggccagcaacctaaataaacagagtcaattataggaccggctctatacattaatgttaaccttggagtacattacgtaatgaaacgaagctctacaagaaaagtatgatacacttatctaatgctaattcaatctcctcatgattagaccacaagcgcatcttctcactttcatataaacgtatgtcatattaaatagtgtgtgtatgactatgagcggtataatatattagaatccaaggaagtgagattctttagccgcttgaatactttggcgatcgttgattgtattgagcctaaaaagctaatcttttcattttgtaattatagatcaaaccttttgactaatgccaaacaagataatttcccattctctttttattcactttataatagtgttgtcaaaaatattaattcttttgggaaacctatgattcttttatcatatctattaacgccatttttaagcttttcatacaagcaatacctaacacgggagctatcttattaccttatgatgatcgtcacttttaattgtataatcaatttgataaagaaaaaagggatagatacaatacaaattagtgctttgatcatatctaattattgcatgagtgtctttaatttaaggtcgtgaatctttggaaatccgagaggttttttgacttaagtaattgaaagcttttatttatctattattttatttgtagctttttgtaaaaaattgaaacttgtaaaatctgtatagtatttgtttgctcaaaaaagtcaccaagattgagaattgacagaaatagaataataaaatgaacaatttgaaatcaacaagagccaaataatatgcatatataattttgggaattgtggtgttgttttcatttggaccatatctccatgtgaagaaccacttgaccaggagaatatttttgtcccaattgatttcacaatctctagggttttggatagctgagaacatgatcctttgtcctctttacgaaattgatgcaaaaccacttaacaatttgtcccttcgttgaaatttatgctttcgatttttatttgggggggttaggggagggggtgaaatttatggacaatgtgtaaagtataaggaacaacgacacatatatatgctgttagttaggaaatgttaaaattgaacaaactttatagcaatcaaatctttataagtactcagtatttcattaatgcccacatgaccattgactgaagccaacatcaacaagagggtatgcttcaaaatcaaactcaaatctatcaaaagctataaaatatattcacaagtgagttaatgcataattttggtaaatataatctgcataattggtttctctaccaatgatttgcttctttgtttggcgttagatttcgcctccaacattctcacaaagatctctcattgttgcttctataataatagtggctcatcagccccaaaccagctttgcagctactacagaacaacaaaaacatagcactctttgatagttagatagttagattaccagggaatgtcatgaaggtggttctctgataaaaaaacattgtcactttaaaatggagataaagtttctaactttaatcttatgcaaaagaagaggtaaaaccagcagggtcctctcataggtgtcgacaagtgatattacacactgtagaggagattcatggaccaccaaatgcaagtcttaggtcttctcacatggagatattgcaatcatttactcaccagaaatatataagtcgaaaagacaaccgaaatgctatatctgtaagcaatgacccctgctcactaaggagtgagtgagaggtagttgagtgtgaaattgagaaagacacacatagatgacaatgccgatcaggtttacgcaataataataaaaaggcccaacccactaaaatctattagcaaaagcccaatttcagtccatatatgacgaaacgttaaccgtcagggttttactacttgggagaagacggaggcctcttaaatcttaatgctaacagacgaataataatacgccacgtgtataattgaaccgtcaccgccttatcgttaccgctgtcataaacgaatagctattttcgtgctcggaaaaagcagagtaaagctttaaaaa

SEQ ID NO: 181 - DNA, 3000 bp, Arabidopsis thaliana
aggcaaggagtgagaacactgaagctggtgtgatagattcggggaaaggagatgagatcgaagatgacgatgatgatttcattaccaatgaggttaagagaaggctcaaggagttgaggagaaacagtttcatggtgttgatacctgaggaagaagaagaagaagaagaggaatcgtatctagatgaagatgatgatgacggagaagacaagtgttcaagtgagtggagagatgtggttgctgaaggacttcaatggtggggaggttttgatgctgtctatgaaaagtattgcgagcgtatgctcttctttgatcgtttaagctctcagcagctcaaggaaactggtaaaagcttcttgctttgaactgtttttcattgtgatagattggactgatcatggatttgttggttacttttcaatctcttaggcattggaattgctccaagtccttcaactccatcgccaagatctgcatctaagaagctgtcatcgcctttccgatgtctttctctcaaaaagtttgatgttccggaggaagatatcgagcatttgcagccgacagaagttgacgacccttatcaagatctagagacggcctatgttgctcaactctgcctcacttgggaggcacttcactgtcaatacacgcagctgagccacttaatctcatgccaacccgaaaccccgacttgctacaaccatactgcccaactgtttcagcaattcctagtcttgttgcagaggtatatagagaatgaaccgtttgagcaaggctcaagatcggaactttatgctcgtgctagaaatgcaatgcctaagctacttcaagctcctaagattcaaggtgatttctcagctctcatacattgcgcgacttaaaaccttatgtgtagtagtaacacttgaagttggttatgttcaaaacatatcagggtcagataaaaaggagatggagaaagatacaggcttcatggtcctcgctgatgatctcatcaaagtcatagagagctcgatccttactttcaacgtcttcttgaaaatggataagaagaaaccaaatgggggtattcacttgtttgggaaccacaacaacaaccatgtgaattctacaactcctttactactggttcagtcatccattgataaggtacgatttctctgtactcaaatgttattactatcgtatgcttctttggtgtctcataagagaggaacttttgcagaaaagggtgaaagcaaaggagctttcaaagaagacaaaagggctgagaaagaaatcatggcctcaaacatgggaaggtgttcaactcttgtttgcagccattgacatcaaactcgcaacacgggttttgaggatgtcgaaaatcagtaaagagcaacttctatggtgtgaagaaaagatgaaaaagctcaacttttcagctgggaagcttcaaagacacccatctccaattcttttcccttgttgatataataaagtgatgaacacacaatgatttcaaatactgtagcatcaactgttccctttttatacgatctttaagatccggtttggggatttttcttttgcagacaaatcaaagaagaaattgtgtgtgttgttccatttgctttcattcattctcttggcaataagagtccaattccaagaacacacttggtttggtcatagattcactattaagggaccattttcattgttgtcgtttggatttagcacatatgaaagaatccaatgttgtcttgttgatgggaaactaaatccatgatcatgatcatgatggtgatagaaaagtcttattcttctatcactttcattgtttttggccaaagtctttttatttcttttccacactttcctatttaacaaaaatcctaagaactataactataaaactgttgaacagtgttcaggttcttaaaacaaacaattagaatttcttaatccaaaaagaagaagaaacaaaaacaaaaaacttaaagtgtgttttggtggtggcgtagtaacaggcaacagagacaatgccacgtgaacgtatctctttcaactagaagtgtcaacacgtggcaaacctagtcaccaatttggagccaaagcttgaatgaccaaaaagggcttgcttcaccaccaccgttaaagaacatgctgaggggtagtttagtcattataaggagacgacgacctcttcgtgtgcgaatccgtcgtgatgctgaatattgtaatgttgttaaaaatgcgatatcgaaaaactctttaaataaaattttgtgtattaaattaaagactaaaaccttacaataattgccgagaaacaaaaaagtgttaagattagtcttgacttggtgactcgacgaagccccttgaagcaaacttttcaaagggtttagttttaatttctctatctctctttttctctgggtctcttctctcttcaaacattttatttcaagctctttgagaaaacactttcatggaagcttgaatatcaccatcaggtacttaactctgcctcttcttccctcttcctctctgtatctacttttttttcttctacaagtcatgcaaggaactagtttatgaatagaaaatgataaagtttaagtcttttgtttaattttgatctctgattatagcttcaggatatgattctctgtttgtgaagaggttaatgaatgagttcaacggtttcgtgtgcttttataaagatggcgtcttttgatgatcttgttgttgtttttcctgattattgagttgactgaattttttagcttcaggaaatggtaaaaatcttagtctgaaatttcgatccttgatatgtagatttcgttcatgtcttgtcgattacttgtttttttgttcttgtgattaatgaaatttgggaccatatcttaaagttcttagctttttgttctcttatggactaaggttttgctctatgtgtcaggtgttgtgaaatttactttgtatgatatatagaaacttgattataatagaagt

SEQ ID NO: 182 - DNA, 3000 bp, Arabidopsis thaliana
gatagttgattcctaactattcctccaaaaagcaaataaattgttctatctttgaaaatagaaaaagataattaattttaacaagtataaacaactaggtgacactaacaacaaatatttataattcaacacactgaaatttatgagcgatatatagactaaaataaaggtaaatgaaaataaaacttccaaatggcaatattataatgaaaaacaaattttcaaactttttaaaaatttttttaacactatagccatagtaacatcaaaattctctacaatcaatcgtttatagtaaaaatctttgagaatattacattatagggaacttttataaaacatattacacgtttaggaactttctaaaaagtaggcactttgtataaataaatttagctatttaccctttaactatttctctttccttataatctttgtctctctcctagtttctcttctctctctctttctctcccttttcgacaaacacaaaatcactctctcctcatttctcttctctctctctttctctctctttgtcgacgaatacaaaatcaagcggaagataatggattcgctacaatcacgacttgggttaaggatctgtaccatagattttttgctttgtatgtgtttacttacgtaatttaagatcatgggttctgcccaaacttcactcattattcaattttatgagttttgtagctctgaaaccttaattgaagcttttatttttcttccaattctttacttgctagatcttagaatttcagaaacttaaaataaatagaacaaataaccatatgagtcaaacaatgaccatatggattgcaccgctcggacaaacatctatggacaatattatctttgtttactactaatgtgttttatcactagataaaatattctatgtatagtatggatccattttataatgatggttgtgtccatacacaagcaaatattggtcaaagaaaaatggacggtgtacttttaactgatgattatcgtgtgtattgatatgaattgattatgttaattactagatgaccatttggacttgacttcttggacacttgtcaatggacaactatgtctttgatttgctgcgagtgcgttttattgtttagtaaagttatcaccccttttttttatgattacgatatatttatatggtttcagggagagaatcgttctacgtagagattatttgggtgaatgaagtagaaggagcagatttatacaaaaatttggtatagaatggatatgactcagtaaaaaaagtttctctatggacacatatgaatggacttgttattatgtacactgaaaatttattttttgatttttgtttaaatttgcagagatctttaccttcaagacagtagattgaggctacgagaatagatcatatgcatcagatctcgtcgtcttcacaacacacaatttcgctaatgtgaatcatattttcacaaaataaaaaaagaaaacaaaattgtgttcattaaataaaggtaacaaacctacacaaaatcgaaatctagagaggcttctccgtaaagtaaatacataaggtacactatcttcacaaactccatcgttgctctcagcacacacactcagcacttacaaatcttcaactcgccatttaaattttggatttatttagagagagtgatagaaaagacatggttctttgtagagaagaagagagagatgttcttatcagatttagataaccagagaataatttatttttatttcatcttagccatagatctgaaaatatatatttttaattcaacggtctatattaaaaagaacataatcagccacaataaaaaaggaaggttagttaatttacgtcaaaatcgcaggggtaattttgtccattttttcaccaaaagtaaagtaaagtgcctaaactcttggaagtgcctaaaacgtcaaaacattttccaaaagtgcctaatagtgtcacattcccaaaatctttatcaatcagcaccataatcataaaggtatgaatggttgtgacggttatagccgctttttatttactattcataaactataatctataacaatctagattagaaaaaattgaacaaatccacgaaatactaactttgaaccgcttttacataactttaaacagagtggtttactttgctaacagtttagtccgctttgttcaaagccggacgagttttaaatttttataatttcataataaattacgaatacgaaagaaatattggggcaatttgtaaacttaaataaatattgggtcaatttgtaaaattaaagaatttttggggtagaaaataaaacattttccagtctagtttctgtcttcctcgcctttccttgtgttacttgcaataacaaataagcccctctttctctctctaccctctctctctctttctcagctattccacagctccatcaaaccctaacgacgagaccagtcgctatcggcgacgttgattctcctactaattccgaaacctcgacggcgcggccaaaaatctccgccgtggattcaatcttcattgacgattcctccaattttgtccaatttcttccccaaatgttccatccattgttttttatttaggttttcgtcgtcgtcggagccgaaaccgattttgtttgtctgtgaagaggagcgaacagagtcactgattattccaagagaacctgtaagatttatttcctttttttttttgaagatttctgaaagctctctaggttcgtataaaccctaagttcttatgctgcttgtagttagaattctggagttagtcttaattgattagtgttttcgagttgttgtgggaattatgaacttaatcgatagtatatacgttaggatttgagtattgattgctttaggatttcgttttggtattatactctttgatctgatggatgcgaaattgtatcagagttttgtatgagagacaagaagctctgcaatattgaagtggtttc

SEQ ID NO: 183 - DNA, 3000 bp, Arabidopsis thaliana
aggttgtgttcggacatggtccaactttttgtttcaataccgtacggtgagttctagttatagttaccggtaaatccggttttatcgtcgccgttctttggtattttgcctttatttgtctttatttctaataaacttattaagtttcttcattacgaagaaaaagtggaagtttaagagtttcggcttcataagccttgtcgttcaaattttgtagtagtttcacttgatgggcatggcgacgttaagtctcaccggaaaatctttttggttgcttacgtcattgtgatgcttcatgctactttggaatggtggacgctttccttcatatgaaagaaagtttcgttcgtttgttaaatctgagtttaatttcgtttggaagaggaagactagatgtgcaatttctttagagggtcttcagtgctctacttgaagcttctggttttgcggagtgaacgaactttcggtgggtaggcgttcttcgatctcagaaaacatgccggcagtggttggcattctcgacaaacacgttcttctcgtcacgtgtctgtgatttcctcatgaggcgacacatgtctctgtgttgtatggctttcttatcccttcctcgatgggttactatattgggctcggtttgacttttgttgttggacttttgttttaagaaggctttgttttaagaagaaagagatagcaaaataggcaaaatctctatttgcgcaaattggttttggagttgagaagcggatctttgtggttacttttcgttaggatatctgtgtaagagggccttgcagaagttttggattgattggattgcactcatggctccatcagatcgcgtgttaagtgtaaaggttccccgaatggggattaagtgagagattcagtttctccctttttagtatcttattttcttttgagatttctgtaagatttactctttcaatagttcattgttagtttacaaatttgattcgtcttttaccgaccaacatataccatttcatttccaatgaaagcagacaagataaagcagaacttgcagattatgaaaatgttcaattctgagtagatgaaaattaaaggagattatctatatgtgtttgataatttaatatcgtaatgctcattagcctatcgaattctgtaagtggagttttccactattgtaacactttgttgttatatatcaaagccaacacttatgaagaaaaaaaagtaagctattttcgagttcgaacaagatattaatatttagtttacaaattcctctaaataatcgtatgcgctatataatttatgttccaacattatcgttaaaaatattgattttgttatgaaatttatttaagttagagttctatttatgttaaggaataacgatgcatcgttaaacttcactggattataaccttctaaaactattccaaagtcatctaaaagtgatttcaaatacttaaccttatcaaaacaatgattgtttaaattagttctaaactttaaatcgagtacttcctagatggacaaacgaaaatcattaggtacgggcaaaatcgaaagcttataaagagcttccaaatgcatgtggatgatatttcccttatgaacactcttttgaaaagaatggcctagtcgtttattccattgttcatctgtagaacgtttaaaagcttgaaacttgtggactgttcaaaggttttgaagcaagtctccattgcaacaacttaaaatgagttcttctttgttacataaactaatgatgcatgagtgtgttctatcactttgttactttttcagcttaaaatagtttatcccatattcttttgcttattactttttttagctgtattttattttgaacattgagttactcttagatacaaagatatatatgaaggatagtattcgtgtatgtttatgttttaatttacgagtaaaatattttctgaagtcacatgtttgagttttgttgtgtacagtattcttatttgtaatttgttcttaatccggtacttagatcatcataatttatagaaaaataattattttgatgaaatttcattgtattagacgattagttttataaaacttgtaactaaatttctaaatttttagatttatttccacatgatttctgaaaatatcggatatgtagaagaacaaaaattaaaatataatcattgggttgaaataaaaccaccaccaaattaaatcagtctttaaccgacgccaaccaaaaataatcgaaccggagatagtggcagatccgtaataaactaataatctaagggcatagttaattcttcttattaggcaatcgtggatctagaagcggccaaaatctcagccatccaatctctctcacttgttgtctcttgcaatctcccacttctctcaatcttcttcatcttccacaatctccgatcgaatctctctactcagccgtatgttttcacttctctcgtaattgactctttcatgttgggatttgaatcgccgaatctcaaaaccctaattctggtgtttcgattttagttccggagtagttattgagatcaacgtgtttactgattccgattgtatgtagaaatctcatggagattttggattgtcgtcgatatgtttttttttcgattgtactgtttcgttgacgcgtctcttattgaaccgtcgcgtcccatgcacggattcattatggactttggcttgttagattctcgatttcgatctgaaagtttgatactttggattagtttaagatttgctaactcaattttattggattagtgtataatattagtttctttgatcgggaagatgttcaatttgaactgttattagtaaaactgtcgatctttttattctgtgccactatacacgaatgttgctgaattactaaagtttaggtagttttgtcagtatggtttgcttttgcttgtatgtcttatgatgagacatgattccagtctttttatctctgtcttgttcaggaaaaaa

SEQ ID NO: 184 - DNA, 3000 bp, Arabidopsis thaliana
tatgtataaataaattttaaacaattgtcaaaaagacattataacttatacggttatagttgttaaaaaaaaaacttatacggttataccaatagataaactgacattttagatttgagttttttttttttttactttccatgtagatagcgtggaataatacctcatttatatgtatcgttagttgaaataattgacaaaaggaaactattcgtttgctgttctagataaaagcctttaattgagaaaaagaaaatgcctccagctttgacccgttttgcctataaaaggattctctaagatatggactttcctcatcttctcgggtaaacagaatcaactagttttgtttttcctctttcaaaaatgcatttctcttcgtcttcaacatcgtccacttggacaatcttaatcacattgggatgtcttatgcttcatgcatctttgtccgctgctcaactcacccctaccttctacgataggtcatgtcctaatgtcactaacatcgtacgagaaaccattgtaaatgagttaaggtcggaccctcgtatcgctgcgagcatccttcgtcttcacttccacgactgctttgttaatgtaagatattactttttatatatctatagcgttgcggattactgagggccatcttttaaatattagtaaagcagtgtaaaaagtaggaaacaaaagtgataacaagtgtattttgtcatcagcagattcagcacacgcaattgtcttagttaatactctttttgctcaaagactaaatttcacgtagttagatgttactagttgttaactgcttttctttttctatattgaaaattaatattactcatcgacagtgatgttactggttagttgttaatttcttacacaatgatgatgccaaaacatttatgcaatcggattcacgaaaataaagtatccgtgttacagtctaaggaattgcatggtgccgtaccaaacacgatagaaatttaagatccatcaatcatttttcttttttggttgagggatatatatttaaaaaataattctaaaatcatgattattaatttttataattcaattaaaattttgatgaatttaaatattttaatgtgattatatataagtatttcggtatacaaatattatttcggtatggtttattttctattgagttaaaattggttaaaggagtttctctatcactttgttttcattataatttagatatttacagatataccttcactgattacttgcttcagaggaacaaatggttttagtgaatggcaaaaaagtttttaatacattcatgactaatgatttgttaaataaatttttggactttgaaagggttgtgacgcatccatcttgttagacaacacgacatcatttcgaacagagaaagatgcgtttggaaacgcaaattcggctcggggatttccagtgattgatagaatgaaagctgcggtggagagggcatgcccaagaaccgtttcatgcgcagatatgctcaccattgcagctcaacaatctgtcactttggtatgctccattgtcccatattcatttacaaacactgttttcaatatgaaaagtattcaatattaattgaaaaaagcgcgtggtcccgttaagaaaatttgacaaaattaggtctcatatcactagctttgatatcatattaacccaaaagaataatattcaacttttttctcaagaaatagtggatatataaaaatttactttgtgtatatatatctaatcaatgaatttatattacatgactctctttttctctttacatgttaaaaataatctcaagaaaatattattgtaatataatggttattatactataggcaggaggtccttcttggagggttcctttgggaaggagagacagtttacaagcattcctggaactcgctaatgcaaatcttccagctccattctttacacttccacaacttaaagccagcttcagaaatgttggtctcgatcgtccttctgatctcgttgctctctccggtaattaacaaaagaaaattaaacaccattgatacaatatcaattagcgatagtttattactaatctaattatggtatttgttttgtttaggtggtcacacatttggtaaaaatcaatgtcagtttattcttgacagattatacaatttcagcaacacaggtttacccgaccctacactcaacactacttacctccaaactcttcgtggactatgcccccttaatggcaatcgaagtgccttggtagattttgatctacgtacgcctacggttttcgacaacaaatactacgtgaatctcaaagagcgaaaaggtcttatccagagcgaccaagagttgttctctagccccaatgccactgacacaatccccttggtgagagcatatgctgatggcacacaaacattcttcaatgcatttgtggaggcaatgaataggatgggaaacattacaccaactacaggaactcaaggacaaatcagattgaactgtagagttgtgaactccaactctctgctccatgatgtggtggatatcgttgactttgttagctctatgtgagaattgtttacccaatatgtggctacaagaatacatatatattaatgaataaaactctcaagacgtttacttgagaacatttattttagttctctccttttctagaagtgtatatacgccaccactaggtgtctctcactcaaggagaagcagatttgtattattaagctcattgcgcagtttgtggcggggtatgggaaggtgtttcaacgggatttgaaggcgataattgttaagagccatgagcagtttgactttttgaagccaactaatagcaacttcggtctttttaatgcccttgttacttcgtattcacgagtattaaaacattccaagggttctccctcctttcttgatcgtattttcgaccatcttcgattggagaagctggaggagggaagggatacggtt

SEQ ID NO: 185 - DNA, 3000 bp, Arabidopsis thaliana
ttagatatacgttattcttaaggatgtaattgcctttccaaaaaggctgatttggcacccaaaagctaaatcttgtttgacgttaaataaaacaccaaaatgagaactacaagcgagtgggaaagcactactccacaaattaagagatcactaacaaaatcgaatagaggtcatgaaagttttgtaaatgaaaaaggagacatgcctggtaaagaaatcttccatttcatcagctgtaaccaaaatagtgtgtggctgaaccaaatctttaacgtcctttaattttatgattggagccaccactttatttattccaggatctgagtatttttataaacataaaacttagaggacctcatcaacagataaaaatcatgtagctgagaggcccaaaagaagcttacttgaacatccaatctctccagacagattgagaagacgtacacaaggaaacccatcaacagcaacatacattagcttctgaaggtcaggtacagattcaatagatgttatctcatctacacaaaacgaaacctcaatttcagattacaatgttctatcaactaatacatttcatcaccaattttatccggggaaaggaaactcaccagcgagagagagatgaagaggaaggattgaaagtagaacaagtgtaaaagctatagaaagaagacgaataagtcccattgccatagcatccgtcagagagttgcgattattagcggaagctacttgcaaatcatcgctgcagatacgatcaagaataatgtgaccgattttataaaagatcaaaaaatgttagaatcggaagaagcagtacctgggaaacgaaaaaaggggaaattggaagagagagcgagagagaggtccgattcgccggagaaatggaaacctagctcggaattacgcggtgggagtctgagtcaaagactgagatttttcgtgttgattcttatgtctttcaaaattcccaagatatagaaaaattgaggtattcacattttgtgcggattttattatattaaaagtaattaagtgaacctatctatatatatatttttgcagccattttgtaaaataaatcctagatttggaacttatttacaatggctgccactggcttttatttatttattttcttttagcaataaattgattaacaaacaaaaaatattccaaatatattccaatcccatatatcacgcagatttctccaaaatttgaactagatttcggaaattatttaaaacaaaaaatatttgacaaaccaaaatacaattgcaatcccttaaaatgagcaaaacgcacataaatacatttcttatcagttcactaaatcttatttctccaaaatttgaattagatttcgacaactatttaaaacaaaaatttgtttgacaaactaaaatataattgcaatcccgtaatttttttttttaaattagcggtgtactacaaatttttttaacgggacgggtttggcagaacgggtttggaaggatgttacttaataacaattgtaaactataaaatataaatattttatagataaatataatttacagacttttatatatactaattttaaaaaataattgtctccgcggtgtaccgcgggttataatctagttgtttatacaaaaagaaaaaatattttcattccacattttctttttttttttgtaagaaatttgtattacattttatggcttcatttttacaaaatcgtagactaattatgattgattagggtattatttgctagattatataggcaagttttggctaaaaattgataaaaaaaaaaacatattgtatatggtaaaactataattttaaagaaattattccatatgtgattttaacaaataacgtagatcatgtataaactgcatgttaattaagaaaaaactagtgttaattttgaaaacaatgtgtaaaaaaaatataaggcgcaaattctcatccaacttgaaagttttttttgcataaaaatcaaatttgtcgtatattaagatcggtaataagccgtaatataagattggtcgcatcataataaaaagtgactacacctccttgatagtctcgcttaggcatcttttaggtcatatcaatacaacatacacatatacatatttttcaacacctgaggtgcgcgaagatagacacttcttcatcctctccgtaattctcaaaattagggttttcttccggcagctctctcaggtactttctcgctctttcttctttcatctcattgcgcctctcttcgtttcctttcgtgaatctttttttttggttggggatccaaaattgggatttgtgtaactcttcttatcttaattaaaaactgaatctttctctcatttttgttccaatgattgctaagttagcttaaacacgcctttgattgacatttctctgagttatagctttgtatgtgtattgggttgttcttggttgtatctatcattgtggtcaatttgtgtgaaataatcaaatagaattgtagttataagctgaggattctcttaacaggttagattggcagcataaaaaatatcacttgcaaattctgaacaatgtctgttgtgggagattctaacatggagctggagttttctaagcaaagatactattttgactttagcccttcttatctttcttgttgccatgaatattttaaccttctttgcatctaaccaaggcctatgatatcatggtttttatccgctctcaggggtcatttcgtttcttatctttttttgtttcacctgttgagcatttcatcgccctcttctctctttgtctatttgtttgtcacctttttagccgcattatggcaaagcgtcaattcgaacttcttattcttcttttctattggcctcttattgtttcttttccaacctttcctcggttttattctctctccccacttgcttcttgcttctgtgtctcctccacagttgtactgcaagcattcttttctagatatttaag

SEQ ID NO: 186 - DNA, 3000 bp, Arabidopsis thaliana
tcttaatatacaatacttctttttcatgcattaagccccttacaatgtcgagtaaacaaagcatgtgtccgctaatattgtcttcgagcttggtatttttgtattctgatacggtatttggggacgacatcttttgttgactcgatataagaagggggtttgtggaagaaattgtagtattatatatcaagaatggctctccaaaccatgttgctggccacttagctattatcgaagcgtttgttgcaacatcaatatcatatcttcagctattctgttttagagaggttgagactgaatctatatgatctgaaggacggagatactgctatgcatttggccttgacaggtcgccatgtggagatagctgcatgtctggtaaatgtgaaccaatgtgcttcatttcttgcgagtaaagttggaatatctcccttgtatttggcagtggaagctggcaatgtcccactcgtggtatcaaagttgagaactacaagcaatgaaggaagaaagacgaactttgattttgtacacgtggctttgaaggccaagagtagaagtttgttttgcttcttaccaattagtagctctgtttagtttgtttgactagtttgggacagaagactaaatatttgcatgtgggctaatttatacagatccaagtcttggggatgagtgatgtgaagaagggataaattctctttcaattggagcatccatagggttttataaaggagtatgtaacctgttagtacgattaacgaagagtgtttacgtgtgaaacaatgatggaccctttccactcatttggcagcaacgaatggccatatcagaattgtcaaagagactctaaaacattgtccagattcaaaacacctgcttaacaagcttggttagaacgttctttgcattgcaacaaatagtgggaaatgtaagtgtttgattccgttgttgttatatatgcaattctgtttcattttatttccgcactttgggttgaattgtcctgtttctctatttaaagaaaaaagtgcttcattttgatgctttgtcgatcaaactgaggtttgattcccaagagacacatacagattgtatcataattagctaggtccagtttgatcactgtgattgtagttgacagatagtcaaaatgacctcttgttgttttgctggtgatcattatttcagtacctaagttttttttacccaaccctcacttcaacacatcttttgctgccaccatttcctttcgctttcggccgctggtcacaactcacaacagcaacaatgactaaaagaatctgcactaagtcaatttccagcttcttgttttattaaggaaaatctcgtgccatgtaaattgtcagacttttggtttgtttccagctcatacctggttttgaggtagtctatgttcttggcttgccatttctttttaatcttgagctatgttcttagaggcggctaagcagttcaggacttggttgttggttaacttattgtagcaatacttgttcttatttgggctttgctgggtgatccagaactcggccacaaagcctttcagtttgcctttccatttctgtctttggctctaaactccatgtaggtcgcattctattttggcgtgctcgctacaacaagtgatatactagttattttttttcgttcttcactaaatactagattttaacccgcggtacaccgcggaaacaatttattttttaaagttagtatacataaaagtttgcaaattgtatctatctataaatatttttattttatagtttacaattgttattaagtaacgtcctgccaaacccgtcccgccaacccgtcccataaaaaaaacatttattttattaatgttaatcttatttatgatatgtttatgaattattgtctaaatattttgtaattttgtaataattaaatgctatcaaatatctctgcgatttgacgattataattaaattgttatagtcatggagaaaaacaatatcaaaaatgataattttgtagtaaataaatgatattaaatattttgaaagttttattttagtaactaatcgtgtagttaatgtggagagatttagggaagattgttaaatgtcaaatatttaatttgaagattttttttctaattatcaaaaacaaacattaaaatccagtggcagctattgtaaataagtcccaactataagatttatttcacaaaattgctgcaaaaatgtatatatagatattcagcgcgtattttattttgtgctctattttcttcttgcctattacactgtcccatatattcctggctttggtcgttgtcactgggcaacggatatcctctccgaatgctattatggtttgttgatgaagaagatgctgaaacatatcacacctctggctctggtccgtgtgattgaaacaaaaaagacgaaaggatgtcttcttatctatttgattcagttgttgttttcataactagtaatttattacgttggtttggaaagagtcagtaagcggggatagctcagttgggagagcgtcagactgaagatctcgatccacgctcaccgcattacgttgtcttttcgtttttattttctttctatatatcttttactcattgattgtgttacatgaagcggggatagctcagttgggagagcgtcagactgaagatctgaaggtcgcgtgttcgatccacgctcaccgcaatatttagtcatttaatttttttcccaaagccatgcaaacgacgtcgtttaaaaccaaaacacacagagatagtcatatacggtgtcgctttatgaaaagctcgaattatactaacggtggttttacaatatgaagttcaaaaagcccattaaaaagcccactacatatcccaccgcctttacctctgaaccgactattttttttccaccctttatattcgttgtaacagcagagatttttatagtttggtttctttgaccggagaatctcgattaggttacg

SEQ ID NO: 187 - DNA, 3000 bp, Arabidopsis thaliana
cagcattttaaactaaaagaataatctaaaaccactattttcagctttgattccaaaaacacaataattcttttaagaagatgtacaaaaattcgaaaaaactaggtagatttgctaaatttatccccaataattacaaaaccagataccaaatcaaaacacatgtatattatttccgaactggttcggattaattgattttcaactcatagaaacagcataaaacataggggtaattagaagaagaaaaattatggtaatgtaaatttaaaataatgtagacaaaatcaattaagatgttgtatttgtttaattcttgaccgccactatatgtaaagcctattcttgttcgacgagcagtttgctatttttgaaggctttaaagatttgtttgtcggtcttcaaaaattatatatgattcttttttgtgttttgttctcattcaaacactaccgaaaatcactttccggtagatcatctatcatgaaattgctccagcacaaacatgcttaactgtaaagttttttcgatatgtttaatcgaaaagataagtgcatttcgtggatatagatgatctaattaatttttaaaactcttttcattcactactatatatcctgaaatcgggatgttacaatttatttctgaatttttttaagtgtctcctacataactagatatgttacaaccactatggatcttatttctaaaaagtattgaatacatcatgtctaaattgattaattctcaaatatactacattttatgctattttctgtaacttccatcagaatccaaaatttttttttaacataccataaattttaattttatgatttatgaaatatttatagattttattattttaatatttttaaaaaaatccaaaataatagtatctttttagctaaaatttcttttactgtattttaggatatttctctatctaattgtacaccatacatataaccataatttggtgtaattcagatttaaattaggatgacatcaaaattagtcaaaatcaaaatagcatctctattttattcttatacttccaaggaaaaaaaataaaagagctttaaacgtgtcgttatagctgtaaagctggtgatggaactggtaagttggtaactgcttcgaccaccgtacgaatatggtggttactggttaggctacacggtaatttcttttatttacctgcagtgagaaaggtaaataataatgagtgagagagtaatggataattctgaatttgtaatgtcattgtcattgttttgtcagtaagtgatgctttagttaactcatgtttatccatatgggccattctatgtttcatatatatatatatatatatatatatatatatataatatgttattttactttttataattttgattcttagtctttatcagaaaagaaaaagaattgattcttagttcttggatttatgaaaagtaaataattatgtgcaaagagattctttgataatttttcaatataataaaatattaagaatattatttaaaaaaaaaaaattgagggaagagattcatttgattttacgaaaacgctaaaacgagatggattaaatgttagcctttttcatgacaaatatgttgtaaagcataatcatgtacaaggtaaaataattttgggtttttagtgtttatgtcgtaattctataatttttctcaactacttttttctttgtataatttagcatttttaatatcaaacacttttgattccaaatacagtttatttttattttcttaagactacttaccaaacacacataaacggtttttaatatctaaagttaccaaatgtatgtatttcaaaaaacaatcatcagcaaatttagatgttttgaatttttattagaagaaatgcattgcatggttataattagaaaattaaaataaaatataaatcaggattatatgaccaaaaattgttttaacttttacttagcatttacacataaattaacagaaatataatattttttaaaaaataattttcttataataaaaattgttatattgaaattcgaatattaagatttggcaagtcgccaaaatataatcacactcaacaaatttatattgtctcactaattatctgttcataatacatatatcaaatgtataaatcttaatataataaattttaaactaatttcaactgtcatactaaacaagagtttatacaagtctttacctagtgttatactccctctggaaatgttaaagcttattgtttaagaaaacatattatacacctaaagaaaactatgcattcgttttgtgccatgtgttgttttactagtcgtgactcgtgattctccatatcattacgttaatcccaactctcaactattattatgttattttttactatagaatggaaacttgtagattacttatatgaaggttgattaaaatgtaattaaaatctgtatcttttttataaaaaaagtctcttcatatatgttttagttgatgagtgatggacaagtaaaaataaataaaataagtacatacgttttgttttagtgatataaatatatgatgccaaaaatgtacatatattttctggataaatattagagttgtagatccaggtttgctatgatctagctctgtccgaaaattgcagagcgtgatcttttctctgtagtacgaccgatttgttttactttatccaatcgttttaactttttcaccacggttaaaaaagttaaaatcagatctctaaccattttctcaacgaacctcgctaatatttctcatttaatcaaaatttaatcaccattaatcctttggttgattactcttttgtcctcttcttcttctctcttctctttcttggtggctctcttcttatagccactgttccctttttcattgtattcctcaaatctctttacttgatcgttggttctctcaaaaatcagatttttatttctgggttttgttcgattttgtgatc

SEQ ID NO: 188 - DNA, 3000 bp, Arabidopsis thaliana
aaagccaacgccgcttcagcagccgctttttggatatccttggcgcatgttgactccgggattcgtagccgccaagccgagtcagcgaagttgagacatgctgatcggccacggagggctaatgcagcgacgtcgtgagcacgagctgccatctcagcggtttggaaagtcccgagccaaatcctggttttcttgtttggctctctcacttcagaaacccacttaccggagtttctttgacgaactcctctgtaaattgggtgacgagtctcacgaaacttcttacggcccgccggtttcttcggacaactcgtggccaacgtcggacaataatctccgccttgaggctcgtaatcggagccaaacatttcagaaaaagctgaaaatgagttcattgatcagagtactctgtttcaagaaactggataaggtttaagtagtacgtagttactagagttctcagtctttttggattaataaaagatagtatatctgtcttggtaaagctatttatatctctctctcttttttttcttttcaggtagattctttttcaagtgtgtagttagtataaaaagtgagagtgagaattggtgtttatattggccggaggagagataacggatatgtggggagcacacggagtttttgtctctgtgaatgacacgtgtatagtacatagcgaagcaatcccacgatgttccactcgctgtctgacgtgtgtcctttgacccttgtaaagagacttttgactcttcactcgttaacctttatgagttctttaaattctatcgagtgtgtgcctgtgtggttggctggctgctgttgttacaatcgtttttaaattcctatgaataaacaaattgtcattaattgtcacccgtctataacataatagacataaatatctctgtgaaatgatattttaaatactcatgtagtatttgtattggaagtagatgtcctaatatttaaccaaaaataatactacaatatagaaaagcttgattttttaaaaaaattaatcagatttggtaatggataattatcaatttcgatggacggttaaaaatgagtcataaatgcatatgatgaacaaaattattcagtttaaacaaactataaccaaaaacatgtaaatggaccaggacaggactaagcgaaggattagaccaatacaaaatagcaagttatcttgaatcccaataattcccacaaaatatctcaatctcaataatagctatattgtattgacaaaaaaaaggtataaaaaatcttcacaataagatatgcatgaaatatattcgctgacaaaaatatctctctcgttacctctcgctctcacgttattgacatttaggagaaaagaagacacaacaaagagggaaaaaaagagtggtaaggtgaagaaaacaacaaaattggctttagtggaaaatagaaagtaaagcttgagagtgacgtatggggccagtgaaggctggtggggaaggtagggacagtgtttccgcggccgaaccacgggtttagaggattttgacgtccccacgcattatcttgtggaacccatctttctgtttttggaaaatcgtacggacgttcgtttttgaattatttgctgaatcgggttgtttgggtttctactctgttttgggattcttcagtggattggactggatcttttgtagctttttgttggtagatttgagacgcctctattttatgaatatcttaatagctttttgttgcatattcaagcgagataagaagataattgaggctttatggcatatttgaaaagtcgaaactcgttctcattccacgtgtgatgatatgttcgtggccacatatcattcggccttgaaagcaactactaaactcttaacataagtgaagcaatccaatgaagaggaaaacaatttatttaattaattgtaatatataaatatacacatttctttataacaacaattattaaacttactaacaaactcatatgtttcatcgaatccaaaacttgacatgtgggatcttgagagtgttaagttgcaagactttttaaaaacttgtatgcattattcattgtgtagatgttatgtgatacatgttctagttctattaatcagtatattctaatcaaaattaaaaaatctaatatttgtttgtcttcataatctgttattgttttgtttttttagaaagcagcttcaattttgtttacttgttgggcttcttataatttgtttaacatataggcccaatactcctaaaaagtagacgttctcgacttctcgtccttcagacaaaataagaaagtcaaaatgtgttctgaaaaaaatatctttgaaactaaaaagaaaagaaaataaaataaaaatccaaatgatctctcttgccttctttatctaaatcgtacctaactctgttttcagtttcacctatctctcgacgcgagcttcttcttcttctagggcttccacgcgactacgcctgccaaaatcattctacaggtaaattgatgcagtttattcactctctatatcgtcgtggttctcatctccttcttccttcttttttttttggttggtgaaaagtagaacaagagaattggtccatctcgttttttataagttgaatctcatcagagccttctttgtttttctggtatgaaagattcatgctttcgtggattgttctcgttttctctatcttgtgaatgatattcagatctaactgtagttagattagatctgttgcattgtacttttgattctaatactgtctagttcagttcctagatttaactgatttggagctcgaatagatgagtttcaagtcctaatttactgcaaaacaattcgatttagtgtgagggctctagtttttagtgttaaaagttttcatcttggtgacaaattagttgtgatattcgtgtttaaattatcatttaaggaagtctcatgaatcttttttactattgtggttgtctatacaggaagc

SEQ ID NO: 189 - DNA, 3000 bp, Arabidopsis thaliana
atatttataattgtttgatgtttttctattttattgatttgataaattagatttgtagttgtacacgtttgtttcaagatctaccatgtgattcgcgtttttcttaatagcgtaaaaatcggatggaagattctgtcaaatttttctttgagattctttttccctaccgtgtgaagtagtatttatatggctgtgaatattggttattatttattgatggggtgatggtgatgcgtgattttctcttgtagaaacagtgttgattttagaaaacaattgtgaaaatctcacccacacatgtcattaaaaaacatgtgcatgcatgctcaaaatctctactcattgctgaattatttgttgcaaataatatcttgattttggttttagtttagaccattttcaagtttagtgttctccggatatagaataaacttagattgatttcccttgagaatttgttatacgtaagataaggaatattcatgaaactcataaatgtttctaaatcttttggttgttagagaaactaataacatacgtacggatctcaatatatcacttctatggcaagaaatctgattaacaataattagcaaacctataacactttgtatgataagtccacatcggtaattatagcttgataaaaatttaaaagacatttaatcaaagtaccagaaatcccacaatgccttgtagttaaagactttgtgacttgccaacaatgttaatcgaactctcacagtttttatttattttaaatccatatatgcttaaagtagtcctacaatgatctgaattaaaacaaaaagaaatgacccaaatttatacttaattattacaaattttggtaagacaaaatggtgtgaactctgaagtggtcgccacaaaataaaataaaataaaaaacataaaatggcgtgtgaataaaagaaagactcgtagacgattgaaacatgtcaaatttattcacacggacgttatataaactttgacgtaaccaattgaaatttccaccataaggagtagtgaagtatggtcaatgattaaacgataacaacaattgcatggcgacttctctctctcttttattacttaaaaattgaccgtttaccattattagatgcaccaaccttcattttcattatgattagtatgagttgtttatatgcacaaaaacttataaatgaaggataattgacatatagtcatatagattaatagaggaatgtaaaaaagcacaataaatccttcttttttaactaacaattgtgaaaactatatataacatgtggaagtagttattagagtgaaatggttaaaactattttctaaaaatacgaacgttacttagaatttaaattttgatcaaaggcttcacgtggtaaacacaagagtaatacataaggttaattaagatgaatgttgaaagaaactaacaaatacaaaaagtaaaaataatatatagaataagttaagttattggagtgaatgacaaaataaaataaaaatacatgggacaaagataaacaaaattaatctagggggaaaagaagttacgaacagtaattagaatttcaaatcttcttctcagatttcacgtggtaaacaaaagaagaataaacaagacaaaattgaataatttaataaagaataaaaaatataaaattatattattatggaagtgaatgataaattaagaagttacgaacattaattcgaatttcaaattttattcaggcttcacgtggtaaagtaaacacaagatgaataatttaatgagataaaataaatgggaaaaaggtcatttaaatcaccatttcgccatttgtggtgatttaaatcataaactttgttttttgtgattaaaatgatgtgttgacttcaaataaaattaataactttcgttgacaaagccaaattagtcacatccgtacccacaacttcttcatcgacactaactttttcgtgcaagtcatcaagatttccgtcttcatcttcaccgtcttcctcgccagcagcttcgtatccaatttcatcacaatctttatctcaatcttcgtattattcagttaacgttatgactaatttggctttgtcaacgaaagttactgattttatttgaagtcaacacctaattgatgattttaatcataaaaagcaaagttcatgataaatcaccacgaatggcaaagtggtgatttaaatgacatttttcctcctaaaataaacagaatagaatatatgatatacttacagctattgtttgctagtatccaaataaaaaatttgtacacaatcaatttatattcactatgtattttggttttaaaactccatataccttaagctatatgatttagttttatgtttgttaaaaagattcaagcccattatgagggctgagttgttatattataaggcctaattaaacccaattaagataagcccattgattcttatggcccattgattcttatgggcttaccggcaaaaaacatgaatgttcaacacgtgtcaccaatcgcggagctacaatggacggtgatcattttatcgccggaaaattcccatcttcgcttgcttcctcctcaaaaggtgaaaaattagagcgagagagatagagagagatttcaaaacgaaaatccagagaaagggtcttgccagtttagggcatccttgtgggtgagagagcgattgagagatttcaaaaggtcagtgtgtgagttttcgaattttcacaatgaatctaaaaaaagaagataaatttagtttcatttgtttcttaatcggagagaaatttgtatgccccaaaaacaaaaatgatgaattggtgtttgatgatgataattgtgtgtgagaaagagatgtgcttgtggtttgcaggaggaagaggaagatacgagtgtgagagagatttagagggagagaagaaagagagattctttttgagtgtgttagggtttcatttcctctgcagatctacatttatctcttctc

SEQ ID NO: 190 - DNA, 3000 bp, Arabidopsis thaliana
taaatatacatattttcatataacttgagaattactcgagtcatatcattgtggtacagtggtaccgtacgagtagtaaaggtatagctcctaaaatttcaaatttgaattgtggtttaagtataatcgaatacaatgcaaattgcaaagttgtattagtttgaagttaagcattagagattccagaatatagttaaaagtgtaaagagggattttaaattaaatgacggaaacaaaaagtactttagttactttgtacctgaaggttgatgtagtcatgtaacacaaattttgcatacattaaagtgtaaaactaattcaaagaaattgactaatttcatccacaaatttctttctcgattaggctttttggatattgaaaagataaaaccaaataatcttgaggtgtagaaagattgactcgattttcagatcggtttggttttggtttaggcaaattctttaaccgttcaactggaatccattacatcagatcaccaacagcaacaaaacacaaaatttgaaaagccgtcaagttcttacatgatccatgcctactccgatagaaaaatggaaaagaaaaaaaagatcttccatttgtttagccttagagtacgtacatgcagcaaaagcatagtttctcttctgaaacttcttctctcactcaagcttgaatcttacgacgctgtctcagtcttccaccaatactatttgggtttggttcagcagacatctttcgcttgcttcttgtttctcggttctctttgtttgcagagttagccatcctctcagtttcactgcactgagcctcaagatcgatgatcacaggagttgctggatccacctctttcacatctaatggcttgagatcaccatcagtcactgaagtttggttgttcccagacgacaagaagcataatgactttctagctgaatccggattcttgtttgagccatcatcatcatcgagattttcgtcaatttgattgtcctgaatcccatcagttatgagaaggagatgatctccttctgaagcttgactatctgcaggagcatcagtttcatcatcctcacttgtttctgactgttggttggtttgaatcagataatgtgcaacagacttatacccgagtttatgtatctgagaacaaaagaaattcaaagggaaagccattaacttttgaatctatccaaggactcaaaatcagaattttcaccatggatcatactaatcgaaatagctaccttcctgtaagctgcaccagttgggagccaccctttttttgtacgacagaaactgcagttgcagatatcgcgacagactggacaaatccagtccggattttccagagcttcaagaacatgttctccatatctgttcaatcaccaaaacataacctaaaacattcagttccaatcctcattttgctgagcaaagcaagctactcaattcccagttgattctcacaaaaggaattactcaaaaacacagaaacaaagaaggttggaggctaatgtacctcatgtataaacaatctccacagaattgacctcgaacagaatggttacactggctgcattgggtatgataacctagcgtcttctgcctgtaaaatccacagtaaccattaaacacattagcctcaatcctaaccgaatcaaactacatcttcagagataaagccaagtgtacaaacctgcactggtggcaacactttcctctaacagggtcataaatccgtttcccatttttgtcacaaccatcaacaaaaagctcccaagttcgttctgtgttacctaacagtttctcatgctcctcagtgtaaatctctggccttacgccttctcctacccacaaaacaatctcttctttagacactttacccttcttcagttcaggttcctctgcgtaggaaactggtgtagcgttcttcaatctaaagaccacaacagagaaggcaataaaaatcattactttctattaaaaatcctagcttcctgttaaacccttgattttgaacagaatccaaagaacgaaacgagaaccacagagattgaatacgaagagattacctcgaggatctccgagaaactggcggctcctgcttcaatctgattataaaacagcgaaatgatttctctaaaaaccctagatttctctaaaacccctaattttggaagattgaagcaatgtgaacaaaatcgagagaagtcagtgactgaaaacgaagagattaccttgaggatcgtctagaggagacggaaagctgaataggagatgtttctcgacccggattggcattagagttaccgtaacgccttttggcgggtcggatctcggatttgagtttgagagagagatccatgattccgagattcttcatcctctgaagattctccttgatcctgtcttctctgcatttctcgtagatcgagacgtttgagtttcctcctccgactgttggattagggtttgtgacgggaatcgaacatttcgctctcgttctcaccacaggcattgtgagagattgatgaactgattttggattcaaagttccaatctttccctctttctctctttggatctctggataagaagaagaaatgaaagatttttttttaactttttaagtgagtgaagcggaacagcaacggtctggtttttttactctttttaaaattcaaaacatttttcacctttttaggtaaatgtgcttaatttgccaactaatgaaaacgttgattggtttgtcaaatggaaatcatatttattatctatcatacatctgtaaatttatttttcttaaagggcctttaggctttaataacggcccataaaaaatcccaaattgtactacgaagaagaataagccgccattctttatctttccattccttcctggagattacgcattaatatatttagatcttaggtcttattagcttctttattcgcacttttttttttcctctactcgaagcttaacgatcgtaacaatc

SEQ ID NO: 191 - DNA, 3000 bp, Arabidopsis thaliana
tttagttataaatatttttattggttgggttttattttcaaattaattttctcttgctttgctcttctattctctcaaaccttgtcctcccaaagatatgttatgtaaattaattaaaggaaatcaaattctgttaatgattatctgtaactttgtttttgtcaaacaatgattatctgtaactaagttcgtcgtattatacgcgtaatgatatatagtcgtgtctagtgtgtcatatgactcgtgttatacgcttcaacttatcctacatgtacctaaaggcgtgcaagcaaaattttgtttctaagcttatttgtgtagaaaaatacaaaagcaataaataatttgggtaaacttttgcatgtgatcaatggatggatatagtacacattgctacttatgttttcaagaaactctagtacgcaagaatagacacgagttcgaatattttgataaattggaataaacttgttgaatttgtagatagttatccattttatatattaggtgtcatacattgacacccaaattcaaaagtttatgtgtactttgtaattgtatgatgcatgtatttaatatagagtagattatagtgtcatttgagtcatcgttttcaaaaaagaagaaggtaaattgttaatgtcttcaatatatagctctattggtaagtgtaaagaaattggtgataaaaacgtagactaaaacattaagagcaattagcaacttaaaacctaaaacaatagcaaatttcatgatatgtaagaaatcgtttgaaaatagattataaaacaacgacaaatattaatatcgtagcttcggtggtttacatttgaagtaactttagatgacgacctaagtatcattaataaacaataagattacctgctaatcttggttaacggatagcttgatgctacaactggaaccggtttgctatataaccggttattggttaagaaccggtcaggttaggttagattagacctgatgttagtgtcaataccctacactttgtttgtgttcaagagttcaccataaagagattcgacgaatccaacggctcgtgagtgaagggtgcatagagatcggagagtagagaatcgaagcaggcgtaggatatttgttttgttgacgtcaaccatagaaagatatacacgtggaggtattgagaagagcgtcttaagaataaatgcttttcttggttttcttattaaaacagtaaaaatgcttttcttgttaaagaaaaaaaataaaaattccttgactaatccttcacgccgcgtctagcccattaaaaattttcggacaacaacaacaacaacttcgctttcctatctctttcagctttgctacactaaacttggcttatcattgctaatatggctcgactcggcttaattttgactaaccacaaatgttttgtaaaaatttcagtaaaaataaaacaaaaattaagcgaaataaatatctagggaaactatattacgcaatgtctaattaggaaactaaatcattatatttatcccaaagatattccaaaagatgattatccactagatattatctgattcgttgtaggtgaaaaaagaagaatgagaaagaacgtgaagactgtaacaagcacacaaaaaaagattgttaaaaacaaccaaataaaacgttattttcaatgtatgtatatccattttagtcggtgttaatgcgtttttatcgtttcctttttctcacgcaaaaactttttatttgggggtttttaacatctgtactcacgctaaagttctatcttctaaacatttggcatggggaatccattcatttattaatttaataaaaactttaagataattgatgaagtataaaattctgtattatcaacacaagaagagaaaaaaaaaacaaacataattcgccgatcgaggagcagccaggatccaacgactgcagtcgcgagtccgtaaatgtatatatatatccattaaaaaaaggaaattgtaatcctaatccaacggttgagataaaagctcacaccgtaacgctagatccatggcagaaacagcgtagcaaaaatctttttctttctctcattgttgttttgtcttgtttctaccattcatttttttttccttgttgttgcgtaatccaactaaccgaaaaaaaccaaactctttcttttctccatttctctctctcttggagggagtgccggaatctaatcggagttatcaccggaattacggttttgcttccgtgcaaagtttttacttgctcgtttggaattcacgacgtgtccgtcagaggaagcagaatttgaaattgaagcaccgattcactttttttttgttttggaaattatatatagatataattctctctgctggttatgatgatgattggatagaaagaaacaaaaaggaaagccaaagatataagaagaactctttctctctctgtttctgtctctctgctccttttgccacgtgaagtttagagaagaagaaggtttacgagatccgtttcagtaatttttagctgcttcaatttgcttttggacgaattacgaagagaagaagcacaattgatctggtaagtttttgtctttgtttgttgggttaattgttgattagggtttttgttattgattatctttgtgctcaacttttgaatttggtaggagttggttcttctctgcttctattaaaagatctgaatttaggctaattgtagttttatggcgtttttaattccgaattttgtgtctttataatatttttttctagtcaaactaattcttaccctatagattgcttgaatttgcttaatttggtgtctttgattttgagttggattggttttgtaatagaaagctcctgttttatccattgaattgtaatacattctggcatttgagactgggttgggtcccttatgtttgtttctggaggtggtaaaactagaaagttaaaaagtctcattctttgtaatttcttgtcagctggaaca

SEQ ID NO: 192 - DNA, 3000 bp, Arabidopsis thaliana
ctatgctaacattcctgcagattctcttacttccaatgcattgccatgtcttacattttaagaagtaggttgtgtacgttgtattcttatctgttttggaaatgacaggatgaactaaacaactcctccaatgaagatagaatcttgcaagcgttgatcaaaatgggctatttgagggaagatgctgctatagctatagagagatgtggtaaaacgtttacatgaagataatatatctcttatctttctgtttaaatctgcaagaagtttacatgcattcctctcgcatagatccaattagctagcgtccttgcaaagtattcatgtttcttctcaaacgtttcaggagaagatgcaagtatggaagaggtggtagacttcatttgtgcagctcagatggcacggcagttcgatgagatttatgcagaacctgacaagaaagaggtaataactctaagtctcttgtagaacctaagacacccatcaaatttattattgaattatccttctgcaattcttgtcagtttgatgagacggctccggttgtctactttaaaattgtgttattgattaacttcgtcatatacttggattaagtagggctgtgatcaatcgatgagaattagttttttgctcatatgtttgaaggatttagtctatccagacctctagggttttcctgtaacctgtatgttgttaactttattcagaacttcaatttttgatttcgtaatccattccattgttctgtgccagatgcattatttggattgttgtaggcttgtagctattaactatagttttcaaattagaaaagctctttggattgtgaatttgtgatctttgccatctttttaccttggtcagtctgattgatgatggatgatatacatgtctctggatttcattggtcttacctattattgaccgtttctgtttttgattggactagagatgctttggtttaagatggcactttgatttcttgtcgtagttctactcggtgtttcactaacttactgatgttactaatactgttctgtttctaatcatctttgcatttatacaattcttcctcaagcctctttaaatgttttttgcctgtgttgattgggattcagcctttctgtcagactattgtatctatcatgtcacttaacatgtttttacttcagtatgctgctcttgttcttggtagacttcatttgtgttttgttactgtgtgtggctaaatagaagaacttaccaaaaacgcactgaaccttgactttttgactggtgcagcttatgaataacaacaaaaaaaggcgaacatacactgagacaccaagaaagccgaacacggaccagctcatctctctaccaaaagagatgattgggtttggtgtccctaatcatcccggacttatgatgcacagaccagtcccaattccggatattgctcgtggcccgcccttcttttactatgagaacgttgctatgacaccaaaaggtgtttgggccaagatctccagccacttgtacgacatcgttcctgaattcgtggattcaaagcatttttgtgccgctgcaagaaagagggggtatatccataatctgccaatccagaataggtttcagattcaacctccacaacacaataccatccaagaagcctttccattgaccaagcgatggtggcctagttgggatgggagaacgaagttgaattgtctgttgacttgtattgccagttctagactcacagaaaaaatacgcgaagctcttgagagatatgatggagagacacctctagatgttcaaaaatgggttatgtatgaatgcaaaaagtggaatttggtttgggtaggtaaaaacaagcttgccccgctggacgcagatgagatggaaaagcttttaggcttcccgagagatcatactcgaggaggaggtatcagcacaactgatcgctacaagtctttagggaactcgtttcaggtatgttacttatatcagttcagcttttggtttgaaaggtgtttggggttctaaactcagttgtgtttttatatgcaaggttgatacagttgcttatcacttgtctgtgcttaagcctctgttcccaaatggaatcaacgtcctgtcactcttcacgggcattggtggtggagaagttgcactccatcgactccaaattaagatgaatgttgttgtgtctgtggagatttcagatgcgaacagaaacatattgagaagcttttgggagcagacgaatcaaaagggtatcctgagagagtttaaagatgttcaaaagctagacgacaatacgattgagcggcttatggacgagtacggaggattcgacttagtcataggaggaagtccgtgtaacaatcttgccggaggcaatcgccatcatcgggtcggtcttggaggagagcactcgtcactcttcttcgactattgtaggattctcgaggctgttcgtcgcaaagcacgacatatgaggagatgaaggatttgaagacccaagttgttctgttttgtaaggcactttttcacatgaatcgaacttgtattttgcagattcttgttgttcctttctgctagctagatatactaatccttgcaagaatattttcagattttagtttggcaagtcgtgtaactaagtttcttcctctgcaagaatattttcgataagtttctctccagtagaagcaaactattaaaccaaatcgaaccatattaaaccgaaaccatcacatcattttttgttttgtaatttagatcgaaccatactaaaccgaaattatttcgactttttgttcttgggttcgagacgacgacaagagacaagctctgtctgtggtcgggaaatcgaaaccagagccttggactgtgtctctgctctgtggagtatccattttcgatttcttgaaggtgaatccagcgaatccttaatctcaagctccgagactgtgcaataaacaaaacagtagctagcagcagcagcaacac

SEQ ID NO: 193 - DNA, 3000 bp, Arabidopsis thaliana
aaaacctgttgagaaatcatggcaaccaactgattttctccctgaacctgagtcagaaggattctatgaccaagttaaggagttaagagaaaggtgtaaggagctctctgatgactaccttatagtgcttgttggtgatatgatcacagaggaagcacttccgacttatcagaccatgattaatacattggacggggttagagatgagacgggagcaagtccaactccttgggcagtatggactagggcatggactgcggaagagaatagacatggtgatcttcttaacaagtacctttatctgtctggacgagtagacatgagacagattgaaaaaactattcaatacctcattggttctggaatggtaagctcctttagtataataatatggctagcttttcttataaaggctaaacctacaagtctctttttttggtcgtattgattgtgttttgttttgtaggatccaaaaactgaaaacaatccttacttgggattcatatatacttcttttcaagaaagagctacattcatctcccatggaaacactgctagactggcaaaggatcttggagacttgacacttgggaagatttgtggcaccattgctgctgatgagaggcgccatgaacacgcctacaccaagattgtagagaagctctttgaaattgatcctgataccacagtcgtgggctttgctgacatgatgaggaaaaagatctcgatgcctgctcatttgatgtatgatggtcgtgatgataatctatttgatcacttctcgtccgtggcccagaggcttggtgtctacactgccaaggactatgctgatatactgcaacatcttgtggaaaggtggaatgtggagaagttgtcagacctttctagtgaaggaaacagggcccaggtaacaacattagaaccatgaaaccgtttttgttttcttgtttttgacttgacatgaaacatccaacttctattaagtttgtttactttgttaaaaaacctcaccttgcattaaggaacttacagaacctatcatatctataattgcattgtaacttctcctgtgcacttggagattcatcaaattggaatctgagttctttacactctactctgacttttcgctttgttttaatggcttcgaacaggactacctctgtggattacctgctagaatccgcaaacttgaagagagggctcaagggagaaccaaagaagcagcaaaaaacataccattcagctggatttttggtcgagaagtcagggcttaaaagaagtaatgttaagcaattaattcttccatattataatcccaagcaagctataaaagatcttcaccaacaccttgatgaagaagccagaagtatgttatgttggaaacgtgtgtagataaagtatgtgttagactttgctttgtttggatcacttaaatgacttactccaaagaatttgctttgttttgacgattttatttatttatttctgcacctctatttgttgctagtattgaatccacttctgtaatgttttctcttcttctgaatccaataagatatttaaaaagtaaaattttgtgtttcgttctctctactttcaaatttgtttcttttgtggttaacagtaattacctcactttcttcataaactggttgattttgtaaaagttcaatttttatgcatcaagttcctatgtttgtgtatccgcttaaggaaacgaagtgacaaattataagaaaagactttatatatgtaacagatcattgacgaattacatcaaacactcaaaaaacaaatgaacaaatcacaataatacccaccgaaacagaaccataaaaccaacatttgatattgatctaactcaacagttctcaccacaaaacaaaaggacacaaactttaaacttggaacggccatggccagtccttcggattctcctcactctgaaccttaccagttctcttcatcgcaacgccatcaccaccatcgacataagcatagtacttcaagaagaaagcacacacaagaacgatccaatcaagacaaaagatcacaatacaaagaccaccaccgagtttcaaaatcacagcagcatcttcctcacgcacatacgacttaagactcccgaggaatttagacgtgttggtgaagatgagaacagagacagagccttggaatatagcagtgagcacagttgcaaccatgtgagcggcgtaccaacggtttcttccgcaagatgcagcagcgcagcctgagactgcggcggcgattgtggtggcgtggaggaggatgaggaggaatccgcagatggaagggattagacggagagagagtgtgaggaagatacaacttgaagcagcgccgagaaggatgtagttggagaaaaggaagatcttgtgtgtatggtaatgagactcttctactggtgatgaagaagaaatgaaacccatgatgagttttgagtttttgaaaattttggattttgagaaatgggtttcgttttctttgatgaacagaagaagaagaagagtgtgtgattcgtggaattgagaagagcgcaacgagtttgtttatgtagaagttagtgaagagagagattgtagaaggtaaagtttctaaatatgaccgttgttgaatctggaacggctgtttttgtaacggctagtttgattttaataaggtgggcccaatgattgattataatataataattataaggtgggcctagtgggccgtgtattggtcatgtttatccgggtataatatactgtagtagtaataactatagtggggcctaatgggccgtgtatttgattcatgtttatccgagacaaggatacgattactctatatccaaacaaggtcagggtcctctaccgtcttcctcctgcttccgccattcttcggacttttcgtcgtcgtctctcgaacgcgtcactcttatagtcggttttgtcgttgtcagtaatttgcgatttttgaaggttaacgagaaaa

SEQ ID NO: 194 - DNA, 3000 bp, Arabidopsis thaliana
cctcacatcgatcatgtgtagggcacggccaaacagttggctagtctcaccaagtattcccaagctcagatgcggaacatacaatgcccataacgttttcaaccgtgatcccatgatggggaagatcaaaattgccagtttcaaagacagaaacattagtgcaagtaccatatatggctctctttctgctatttctctgatagatgacccgttgtgtagccatgtgatcaggtttccatcagtgtccaagcttgttggttcaccttcatccatatactggacaggtttaagacctggaaagacacagatataaaaaagtttaactgattttcttcaaaggattttaataagttgtgagctaatatattcagatacagtagaaaacaaaaccagaaagtacaaacagagacacagtctggcttttcatgaagcatactctcacctgttgtttccttgtaaaactgaatcagggatgcaagatcctttggaccatggtatcgcatcttcattgtttgattcaccatcaggattgaaggcaagctatggataccatacctagaaaacacactgcaatatgaacaaaaaaattcatgatatcaattaacatggaccaaaaatgggaaagaaatgatgaaaacatttagtattttagaggataagctactcatgaaacaatttcataaggctaaaagggttatacagcataataacctaactaatctacatttgatgctcaccaaataaactaaaaagtagcctctagcaaagcgtgcaagaataagagacaatgaacacacatagcatcatttctgtcatattgaattatttgtcctgtctttgtaaaactaactcattaagccaaaaactttactgatcagtgtaaaagacggattgattactggcaaatctaaacaatctgacaagtaattcaagtcattttatttctgcaagggggatatcaacacccaggatttgttgtgaatggttcaattgatccatggcctcactatatcagataagatgtaaatagaataatctaagtattctaagtaagttcttacgatggtaaagcctgagattgctcaacaatcaggtgcgttatgtgaggaaacattgaactcagaacatcaaactttgggcgtactgcacgtgaaaacgggcaccgtgaggtataaaatagtatggatatataggcatttccatggtttgcatccatgagtttgtctagcaagtctccatctacctacattaacaagaacacaaattaagatacttgagttacaaaaacaggcaccctatatagaagcacccacacatatttaatttctttgcaataacatctttgctgcatttcaacattagaaattgaagctaatacattgcaggtgacatgatgagattctgttggtagcttaccactgttgacacaaataaaaggaattcattgcagaacttaagtagaaaagagagatcccacatatcggagaaacaagcatgatcgtgacaaatacatcattagttatacacttttccaaccaaaacaatccaaccatttaagtagattatttcatcataaactaatatattgactggaaacaaacatattaccaccagctttctttttacagtaagggactctatatccattgaacattcctcaaaattctaactgcaggtaaactactaccacgttcaaaaaacctctgagacctcaagaaacattggagcaaaggtaaaacatcagtgaagttaagctacaagcctataccgttctcattaagctttgcatagtgaaaaccacaaccaaaagctgaaaaaaagagacttgttgtcacgaccacaacactctaaagtgatatcatgccaaataagcaaaagagggctcgaatcgatccttacaaatcacattatggaagagttatcatctgaattttcaagagatgatatttaagcaaattcttccactttaaaggcacaccaaacgcatgcctaatccaatcgaagataaaaatattcgttttgctataacaatgatgacgtacctcgataggagggcttggatacaaagaacgaggacatttttgctcgatcacggatcggaacacctcgaattcgtgattgcaaacgtcaacgtaagcaaacccagaaggtaagcatgatccagctattgcagagacgaggaatattgaaacccacaaattcattaattaaggatcctaaatctacggcgaaacagaaaaatacagataaagtttcccaaattcgctaagagaatcaccagaaactttttacaatttacaaaatcaaaaacaagagattagataaaagttaaaggtgaaatcgaataacaaaaacacgaaatcaaaccaaagggaaacgtaagattgagcacgagagagcttaaagaacacaactttaagagaaaaactacacgaaacaatcacaaatatagatttggagaaaatctcagatccatgaaaaagtttttattgtcacttgtttttgcagaaacattacattacagatggagaacgccaaaaatcgattcttttttttaattttcttttttgacaaatcgcattcgtcacacattccttttttttttaattttctccactacaccactaatcttgccgtgataggtgcatgtgtatgtgtttaagacatatctcttttgttccggttggattagtttatgtaataaccaacaactatacttaatacattttgtccacttttgaattttctgtttcttattttgtttactgtaaaaaagaatgaaaatcattgagatattaaaactaactaatcactaaggcccatttagtagacccaataaggcccatatgctattttttttctccagaatttgacctttatgtatttgaccgagtggaaaagtaatacagttcttttcttctctcctcctctttcttcttcctgattggaattttagggcttttgaaagcacgaacgcgtgaagctctaatcgagaaaaaa

SEQ ID NO: 195 - DNA, 3000 bp, Arabidopsis thaliana
aagcatacatgagtaataatgctctaaaatatgtaataagatacatgtttactctaaaacatacataaagatatacagatgtaaatgatgaagttttgtttaattaccacaagcctggatgatttcattacaatctacacacgtcctcttccccgtctatgtcctcgccctctaccccttcctcttcctcctcctcttccccttccatggccgaagttatcttctgttcttccgtaatcaaacatattcattctgatatccgctgccccggctccaggcatctcctgcccctatacagaaaattacaataacaaagctcttattgtaaccatttctgtatggatgatcccaaaacacaagtaataagccattgaaagacagataaaaagtgtgctaatcaaaataatgagcatatggaagacgggtcatagggataataaaggttgttgtgactcacataagagtcttccagatcaaactgattctgaagctgccatgcaagatcttcatcgcgggtagtgtcgcttggatggttagctgttggaagagcccccccaccagtattcctcttttcccactcatctagtgtaaatactgcagagtcttcttcttctctccccctccctctacctctacctctacccctacctcttcttccttggtattgcctatcatttgaactagaatgtttcatcttctcaagaagtatctgcgcagccgcttggttctgtaaaggaacagcttccaccactgcaacatgggagatgttatttggcgtatagggatgaacgatagatatctgatatctcatctaaggtttcaacgcaattgccagatgaaaatgccaaactaatttaacgctccttaatgttctttgctgtacaatgagcttttgagacgatgagggaaaaagatgatggcaaaccttgtttaggtcgtgtatcggaactgcttcgcttttcctgattttcaacttcgacagatattttcggatcagaatctgcaggattcctctgtatattcttatttgtgcctcttttgttcccatcaacttcactactttcacctttttctccaccggcatgttttacagagctttctgcagcaataggtacattgtttctagaagtcgtcttgttgtaatctgtcaaccaacaaacatatgctgacaagttaaatttttgatgcattggccaaacttccatcacaatactttatgtaagcccacacaaaggaagaacaattcaatagatcataaattttaccacaatgaaaatgcattcactcaagtttaagtattgaaacaatggagacccaacagcgccaatgttggacacaaagccaagggaaaacatagatcagacctctacatgagtcgtcataggttacataaacggatatattgggattttggagctcgggtcaaattactaatatgtttatgctaaagtgcatttggatggaataagtccttgctgcagtcaatgcatatttatgtacactatcaacatgaaatagaaaatggtagatattttatttggtagcaaagattggccaaccgtttcaaagtgaactaaatatgcaacaaattactagaagaaaactgaatgaaaatgatgagaataagaaaatcctgcttaccgcggtgatgggaacctgttcgaatcttcaactcctcaaatggaggagggccatcaccagctttgctttcctgagatcgagccaaactagcgtattttttcttcatctgccattcttcagtgagtgattgcacataaccgcccaagacagtcacctcttttggagtcaaacatactagaccatcacgtatcacagccttattttctagacgtacctgccaacgagacagtacaaaatatcaacaatacaaaatgatttatgatttgcatatgacaccctctgatgcatgacaaacacatatgtgcactagctttctattgatttagatcttaatccaaactattatatttgcatgagactttcagaaacatagtaaaggagaatttgaattagattgatatggaaatggaactaccttagtaccaggagtgacatcattgttaatcgttggtatatgagagtactcaagcgcggatatttcggtcttcccgtcagtcagagcgaattttagcactcgtttaccagtggaacttcccacaaattcctctgcgctacttcttgtaacatccctaacataacttatctatgctcacaaaagaaaacaaattaacactcaacagcttgaatcaactgcaacaattgagcattctgaaactagtttaaatctaagtatatcagtgagagtgactcattgaattagcgaagacctaatgccaattgttactgactttagctgattgaagcaatgtacctggagaactttggggccttgaagatgagaacacctgcgtaactcggtcgggtccgggagggatttacctccgattaacttaatatccatgttaagcagctccgcctccactgactccacgatggcgcctgttttattgccgccgccgatcaaggaagagatttcagtgaccagggatttcaagtattcgacgtctctgaagcaccagccccgactagttagggcatttatcacgacggtgtgggtgtggtcgccggcggaggagcttgatgttcccaccattgcgttgatgctcttgtcgcgctaaaccaattggggaagacgagattttaatttggagaattgattttgttatggtcaatatcgagttaaactaattactattcactaatgatactttttgcataaaatcgttttgatcaataaagaagaacatttttaacagaaaaactagaaaagtaattcgaaaaagtcctataaaaaaggtattttccggtttcgttttagtgggcctaatggcccatatgtaacacgaagatttctgacagtacgacttctaaagtactttgctttccttgttgaattccgaccaaagtcgataaagagtt

SEQ ID NO: 196 - DNA, 3000 bp, Arabidopsis thaliana
tctagttgttggcagtaaaagtaagatttttttttccaacttttcctggtaaaaaacgcaagacaataatttggcacaagcggcttgacgtcactatccttatattactgtaacaacacttactaatacgaaacttaaatcgtgcatgttagataatatagtaattagtacacatattatccatacaaccactacaggtttccaacaatccgtcattaaaaaaagttaaacatacaacaagactcgatatcaattggtacatggatacttaagtttatgctttatagataggttcaagtaattgtctaacacttatagtatggtttatcatggaaagatgaatgtattcaattatacaactattcattaatagtctcgattcagtacgaaatattctcaaataaagattggtgtgacgggccattaagaggaatacaacattcgacaggctttgtctttgtatatcaaagaataaaatcatactgttataataatacaaaggaatgtataataatgttacaaataaatacgtaagttatatagttaggatcaattgacgtcataaatagtaagatatgaaataggtctgttctgattctcttattagttgtcgggtgcagagtaaacagaaacctgcgaactgacacgtcactccggtgatggtcctgctagtaccttccccttcttcgactctccctcactcctcttacctttttttttggggtcaaaagtcatcctaccttttacagtatatactttaattaatgatgtcataattcatcagtttatgtacatttttagtaagaaactaaaatattaatgaaccatttgtcttttgctttgtaaggaactatatatttaatgaacaaatcagttatttagtacgaacagattaaaatttgagactgggaaaactagagtctattaaataatttcatcagtttatgttttttctactaatgacaaagacaaaacatacaaaccaagtcagttttccggttatcaattaaccgaagtatttcttctaactggttaccgaaaagaaattcaatttggtttggttttggttccttctttattttctaaaatcggttcgtaatcatttgcgaaacccgatcaaattttggtaaaaaacggtctaataatggtataatccgttctttaagaaacaaataactatctgagaaaccaatgtcgaaccgaaccgaaattcgcaggttactgaaggcaaattgaaagtacgccaatcggttcagcctagagaaccaaaacctagccgaaaaccaaaaatctatgtttggctcagtacagtattctcggttcgcgtcagaatcacagggcaaatgttaacaacactaaacaatgattgcattgtgtttatggaaaaacaattacaccaatcaccaaatttatccaatctacaaacattaagattcctgtaagtcatcgaatcagatgctttgtgtagacctgacccaccatgcttagtcaagacacaagtaaacacaaaacaaggaatgcttactaattacatctgaatcacaagtgtttttagatcgtgaaacactaactaacatatatcatactaagagcatataaacagagaacatacgcatttgcaacttacaagggaatgttaaaaggatgttgttttttcttgcctaacacttacccttacggtttcagttagctttgcggacttctctggtcagtttctggatgttcaggttgaggaaccgaaacacctccattcattcttgcacgtgcttctgcaaacatacgttgttgctcagctgctgcttcctcctcagtcatttgagctccagggttccatttcacgctcctctgtgtgtcctgctatagagtcacaaatgtaggaaacggttaacattaatcgttttttcgtctcctcgttatcaagagtaggagaagaaagtagagaatcattaccattgtttcatacttatgttgctcatacgcagcatagacttcttcaatgtattctccaaaaccaagaacctgtaatgccttgagaacatgctcaggagcaatcgtccgtttatcctctttgttacaaacatcattagattctgaagatacaagatttataaactctgcaaaaaatgttttaaaccacagtaagaaaaccaagaactctcacatatatagatgaactcagagagaaactatatgatcttacctacacaacattcaatgagaagatcttgagcatctcttgcaacacgaacatctggtggtaacatctcctttataattttagtcatcgtagctaaaacaatagagaacaacaaaacatattcttagcaagataataaaaaaatgaagtttatgatgctcatgaatcctataaccttcaagcagagttatatatagctaggtttacaaatcctcctatttaatgatcaatgagcaataacactaaccttttggaagagaagcgtcttccttggatttgccgactatatccattggatccatagtttaatctacagaattcatcaggttaaaggtgcttgtacacgaagatctgcataaagagcaaatcaaggggagatcggaaaaaaacgagaagatagagataatcgactcaccgtaactgagtcaacacgaaccaaatcggaaagtagacgagtcgcggtgagatctggcgccgggaaatcgatcggattgtacggaatataatcggagggattttctctctccttcgtcttctctagcagagtcgtttagggcaaacggaagaagcaaagcgcgtgaatcacactttcttttacaacgcttagagacggcgcgtgaagataactttaacttccttatagcaattggattttaaaacaaaactaatgggccgaaaagagacccgaaccaggcccagatatctcctccataattctctgattctgcttcttcttcttctctctgggactcgttcagaatctcgaattgctgctgctcctctcggtctcggtggtgaagaca

SEQ ID NO: 197 - DNA, 3000 bp, Arabidopsis thaliana
tgtatagaggagaatgattttttttaaatcaaattataggaaaaaactatgattgtgttgaatagatagacactatatagtatactgcatgaaatttataggataaaaatatgggctatataatttaatgttttaattttaaaagttaagtttttagtaatttgggaaatagtaaatttaaatttgattaaattaatttatttgataaataagaaatctttctataagctaaatatttagaaatccgaaaatattatttttggatggtgtatttaatattaaaatatgtttggtttaaaaaataataaggataaggataaggatagtggaattaatagtgtttgacaatgagtatattatattcaataaatgaaaaataaaaatgatgagaacaattatgggcttgccacatcttttactatatagaggattccaaaaagttggaagaaaaacaattcctaaattgaaaagatttttttctttttcttgctatgaatgtaaataaaatctcaaaaaaaaaattaggagatgatatatatcaagatgaataaagacgaaagagacttaaaatttgttactgcttcccttctgtcatctttgtattatttcctatcatattgttaggaaagatttatttctttacatatgagaaatatgacagcatcaaattcaatgtgcatcaaacgttttgactatttttgattttcttccaaaattaaaacgacaaatttgattttgaaagcaacttttaaaaatacgtttcgccaaactaattacagtataaattggatctcatagccaataactttatctcatcaaacaaaactcaagtcatctatttctcttgttgcatagtcccccaaatattcatcatgtcgatcaagagtgttgtttctctcctagtagttgtatgcatcgcagcctccgttaatgctcagctaccgcagtttcccccaatcatgttcccgtttccaaatccgttcaaaccaagtcccggtatggcaggaagtcccgacttgagcaaatgttggtcaacagtgatggatttgccgggatgctttgaagagattcaacaagccgtaatgtccggcaaatttgaaggcgttggtcctgcttgttgtaaagctttccttgacgctgaagctaactgcttaccaaatcttccatccaacccgtttttccctcctatgatgaaacaccaatgctccaaaatggctagtcctccaaccaccaccgcctattagaatgcaaaaatgtagttgtgttttttcgaattttttgttagtcccagaatgttctagaagaagaaatgataataataatgtcttaatctaataataatgtctcatttcttatattgtgctccatatgattgatgttctttcttcttttgattgatgaatgaatctcaaagacatgttgcgtgatatctcttatgcggttatgacaatgctttctatataactcgacatgtagaccgatcacacacaatttagaatacatcacatacattacatactatcaaacaaaaatgttccaaaataatgaaaagaagatcacgcccaagctcttttcctaggggaaagatcagaagtcttgatatcatctattttagccgccattatgaaatcattcatgctcaaccctcctgcattattcatccaacaaaccgtcttaagaaaccatatattaaaactcaaactcgaacatcaaatatttgacataccgatagaagaggtaaatagttcagctcgaacttgggtaggactttccaagtgaagagaagggtaatgaccagaagcttcagcaaccttatggatcctgtttatgagttcaacaccgcacccaaaatccctcactttccacatacaccttattttcagaccacccgcttcattatccactatactccatcccaaaacctaaaacgtttacataataatcattgagattgatgtaccacatcattagagtggtaaccgtgaaccaaaacaccaacatgagccttatcaacactaatcatttcatttttttttaatctcgtaaccattgttcctaatatgtccctcatgatactaaaattttcattggcttttctatatttttgggtcacaattctatctttatagattagaaatctgttaaacgcagaatcaataacattttcacaatattttgatcaaccaacaaacttgtaaaatcaaaactcgaacatttttatactaagagagaaatagtataagtaccttgtggaggagagttctggcatcatcgccggacaaaggaggctgtgaagacgaaacaggggaacactgaagctgggagagagacaaaacagatgcgtttggtatcaaaatcttgtgctcagtgctttggcatcccaacactttatctccgaattgactcgctatctcctccgggtaagggtcacgagctccgaagtcaccaagaaaatcctgcgccagattagaccgggtcaccgttaaccggccgagtttacggttattcctacttacaggtggtaataaaccgaacactttaaggattgagcgagaaggttgacggaggaggagggaggacgcggagatgttacacggcggtgatgatgacgtggcggccatcgggagctgtgatttgctctgtaccgaagataagagttttggtttttagagagcgaaacgattttcagaccactggactgagttaaatgggtgaggtgccacgtaatcactaatgactaatgggaaccacaataaactttcgtgggaccgactttacacgtcacgttttaatctgagaagcccattgggtttgattgtacttttgtgtccacttttggtgaatctacttaagatttcataattccgaaagtatcctttttgggtatctttaattacaaacaaaccttcccttctttcccgatttcaagccctaaaattccgagacttctgtttctcgctttaacgacagtcgccgagtgagagatatagagagagaaag

SEQ ID NO: 198 - DNA, 3000 bp, Arabidopsis thaliana
tctgtttttcgcctctgttcacctctctggttacacagcgcttttcatctcatggctcgccaatttcaaactcatactcttctccttcaatcaaggcccactttttccacttccctcaaatctcacccgattcatctgcttcgcttgcttccccatcaagcttcaacaaaaccctaagcgccgagactatttcttccaatgggaataccccattgaagttttgtttagtaaccaattcgtgactaaagttgtaatcttgagtgtagtgttacatatgtataatcacatacaacatatatatcccattgtgctatttgttctctatccactccatctatacttggtacttgagattctcttaaagctcttcaacgctttcttctctatagctcttgattgcgaactcgagccacagctgaatgaaccatacttggcctattctcttcgagacttctggggtcactggtggacactcatgctcccgacgatcctcctgccagacgtctacgctaggatgcggcgaatcactgaagggaaaatgaactccgagaatgctctgtacttgggagtttttgtcacattccttgtctccggtgcacttcacgagtttctcttcttctatataactcgtgagcggcctactggagaggttactctgttcttcgtgttacatggggtttgcattgtggcgtacgacgccaggttaaagaagaagattgcgcggtggatagggtttgaattttgcccgtgtttgatattacaagtgatggttatggggtttgtcgttgtgactgctggttggttgtttttccctcctcttgtcaggaccggcaagattcagagattcgctaacgaagccttgctcttcattggtttcgtgcgcaacttgtttaacgaatccttgttcttcatgcgtaagttttttaacgaagccttgttcttcactggtttcgtcatgcgcaagttgtttaacggagccttgtttttcattggtttcgtcaagctcaagttgtttaacgaatcctccttgttcttcatcatgcgcaagttgtttaacgaagccatgttcttcattggtttcgtcatacgcaagttgtttaacgaagccatgttcttcattggtttcgtcaagctcaagttgtttacttttggctggtgataaattgctaaatcatgatataagggatttaagtgtttctgtagctcgattatcatatcatctctctctgtttcaaaacaattgtggctttacaatttcaatgtgatttatttatttatataagtttactagtttacccttgaatggtaaaaagatttcttattttgtgtgagatgcaaaacgaaggctctaaatggcctttgaattcagctgaattcaacggtaaaggtaagcatctcaccttctacaatatgaaaagcaaagataataagcccttcttacaatctagggatgtgttaaaaaaccagagatgaacaaggcttcgttaaacaactcgcgcatgatgaagaacaaggattcactatgttatcgcgtcaaggttcttgctgctactgtatgatttatgtgtcacaaagcttaaacatgttttttttttttttgctaatatcatttttatttggaatgcatgttctcttttggtgtatgcaactatgtaaagaacacatcaaaatactcattggtccttgctaaaggtttagagacgttccaatggctctttgttttagggaatgcaaggtgatcacgtatacatatgtgaaataagagttaaaacgagtaatgtatcttgttcttgttttcacacaaatactaagtcattggaacagagcattctccgtacgtctttagtacatttaattaagggtttgtttgacaagtctttagtacattgatttttctagctagtaaagtctatacgattatggaaacgttttgaagtcactataatattcaaaacaaaacgttcccatagtcacaaagtttaggacgggtgatgattagtaggcatgtccattttaagacgggttgaatttcgtgaacttttattccgaagtcaattcttagccaaactagttaacttttacgcgtttcaaaatcaacctttatccaaattagtgatagtttgaaaagtgaatttaactacaaatgttttatgaattcattttgtaacctatcttcagtcaaattagtgaatatttatttattttgccaaagtcaactcttagcttaattaatgaatacttgaaaagtaaatttggctacattttcatacaatttttttatggctacatgaatttaacccaatctgaattccatctcgtaacatgaaattttcatttcgttatggccattaatggtgacatagaccgcacccaaaaccgtaccgcaacagtgctgtaacagtatcaaaatctttacatatacatatgtatctatatattttcgttactatttgaaccgcaccgcacttctcctgcaccgcaaaacgcagccaccattcaaatcaataggtatcaaaaataattcaggttgtgttttttactattcggattgcccgtttctgatttttattcgctagtatctgttctaatatctgaaataaatgtatttagcgatcaatatttttctttcccctataatataaatcaatatttttgttttctaaaataataaaacttaaatttgtgattgccttatgtctatgaatttattaaaaatttaatttcgttaagtgttttgttttttcgtgatattattttttagttcaactttttcttgatatgattattcattatttatatagggaatagagttttttattttttattttgcaatcatagagttttaccatagacgaacgccttttattcgtcgtggcgaacgaaaccctaatcatcacttctccacttttgttcgtcatcctcttcaaaatttcttcaatttgattctgcaatttcctttatctctctctggattaagtttcaatttcttcttagcccgcc

SEQ ID NO: 199 - DNA, 3000 bp, Arabidopsis thaliana
aattcaagcttggtctctatgttttagaaaaaaagaaaaacttagagaagcaattgttatttatctcatcacaccaatataatttttggaaccaaattgttaaattaccaaatgtcccaaacttgtgatcaaatttagatgattatttttaaatgaacattaaagaaaaactattatatatatacacacccattatagacgtaactctactgcttccaacttttccctaatctttgttcttccggccaatcaaatgggtgataaacttcgattatccatcggaattttgggtattgtattctttactttttgtgtaatatacactaccacatgctcttttcttcgattttcaaactttttttcaacttttaaacttagttttcgctctaaaatgtgttttgtttgtaacatgatatctacacgaaatatatttgtatgagttttttttttccgggttcttaatacttatatatggccacttcacaggaaacggagcttctctgttgctatatacagctccaatgtacgtagatgaaaactttataaatcgcaaatttaatttgaataaccaagaaagtagactatgtactatatatgtagattaacattttctttctgtttatgtagagtaacattttcaagggtgtttaagaagaaaagcacagaggaattctcatgttttccttacgttatgacactctttaactgtttgatatatacttggtacggtttaccgattgtgagtcatctttgggagaatcttcctctcgtcaccattaatggagtcggcatccttctcgaatctatcttcattttcatatatttctactacgcatcaccaaaagaaaaggtaaagtattcattagaatcgtatggtactttttcattagggaaaataaaaactagtgacattgatccatatagaatataaactttgaaatagattaaggttggtgttacatttgttccggtgatcgttgggttcggcttaacgacagcaatctcagccttggtatttgacgaccatcgtcaccgaaaatcattcgtcggaagtgttggcctcgtggcttccatctctatgtatggttctcctctcgtcgttatggtaagccatataatcaaaccaactattacatactaggaatattttgtttactaaaaaaatatgaatgcgtgtgtgctaattaatgtgaatatttgagtgtgcgcagaagaaagtgatagagacaagaagtgtggaatacatgccgttttacttgtccttcttctcatttctggctagttccctttggttggcatatggcttactcagccatgatctctttcttgcggttcgtttttttcctaattcactcattttccataattaatagcagtacaaaaatactaaatgtggatttaaaaacttcttgctttgtggaccgaaaagagaaattgtcgaaaatctaaaaaaaaaacgttttcttatggattcttaaaatttagtcaatttttgcggtgatcgatcacaaactaatttgacgttaatcagttcatggtgtttcagtagttgaaatatttatcttaaagttgagaaatcaaaattcgagttctactatgatttcaatcatggttagccattgtagatgcttttaatatatagcaaaaaaaaaaagttttcacatattttgctaattaatcttgattttagtcgttcgacggttattaaagaaaactaatatgatgttacataaatcatttttttgttaatgcgtagaatactacaaaacttttttttttttctcgaaatggttagtggtctaagaaacgaaatataaagaattgttgagatttttttttttttttgagatttcatgtgcattgttttgatgatggcatatatcgaatgtttttttcttacatgtatagtcacctaatatggttgcgactccattgggaattctccaacttatcctctacttcaagtacaagaataagaaggatttagcaccaacaacaatggtgatcaccaaacgaaatgatcatgatgacaagaacaaagccacacttgagtttgttgttgacgttgatcgtaatagtgataccaatgagaagaattctaacaatgcctcatcgatctaatatctcggatgtgttttccccaaaactccttgtaaatccagagatattttatctaaacacctcatatgttgtacgtgctttcattaaataacgttacatcactctatacgttatggtggtgatgatattgttgatcatgtgaaaaataaaggtggaagtgctatgttttcctctgtatttatattataagatcaagtgtatatgtacacgaaagatcaatgtgttgacaaaaatggaaaaaagagttaccgaaacttaaattttttttgacgaatggagaattattgaaatacttttttttttgtgtaaaaatgttaataaagatgggtttaaagtttaaaccacaaaaaacaccattatggttttaatcaactcttcttgaattttgttttaattttacccctagacgtaatactgggctaataaaagcgtaaggcccattaatagttggttctattcataaagcccaataacgaagacgctcttaaaacaaaacgccgtttaaagaaaccgcgataaaacgcacatatggattctcccaaataaatccctatcaccaaatcttcttctcttctttatcttccccaacgcgaaaccctaatttctctgcagatttttcccaaatctcaggtaacatgatctcttttcttatttcggattctttcgtagtaatatatgaactttgctgctaattttttcatcctataacgtatttgaattcttcggctcgataatgattcttcataagcgtcaatttgtttgattttttgacgaatttgttgagatctgaaaattttgtgattcgtactactgtagctgcttctcgttcataaccttggttcgttgtgttatttgtagctctaagattcgttgtgagca

SEQ ID NO: 200 - DNA, 3000 bp, Arabidopsis thaliana
agttgacgcgtgaaatgtggtgaaaaaggttaagtaaggtttcaagcgatcgatcttttcttggggagaggtgttcttttttccttctcatttcagtaattaattttgtgcatgtacatgcacatgcttattcgcttacgcgttcacaacataagagtaaaaataaattatgtgtgatatacgtaatcaaaacatattaattttagacagcctctcgtactaataatgtagtaatgcatttgtaatatgttaccaggtgtgagagaactatctttggaatatggttgattttacatgtggtgatcatttgaattcattattataggttagcacttaccaatgctaactttcatgttatttttttattgataccatgttaatcagagtgttctatatatatcggtttttttaaaaaaacttcaaattataatgacaacatataacaaaaatagaaaataaagatgaggattctaactctttcgaccaaaggaaaccatgcaaatggctgaactttacggttcagaatcggtgttttttcatggatctccgctaatcgagttttcgtttatgtttttcttgtttgtgttgtattgtagtttttggtggtttttttttttatgttctctgtatgtaaatttcaaaaatgatataaatttaactttttaccaaaaaaatataaactaaaataaaaactgcatatgcgtgacaaaccatgacggaatccatcgctttgcctcatgggacggtctgagatgattcaggcgagatgcaaggagacgcaaaggcgtgattttgattaaaagaaaattacttattgattttatttgtcgtgaaaaccacgaaccactaatttatatatttctaaataaagcaaattgaagctatatacatcctgcctctaatggacacttgctttaacttgaattctaaagttctcgatccgcatacgcccaatcaaccacgattatataatttaatatatgaaaggccatttttacattgtaacttgtaacaatagaataatatgaaaataatctatataagtcaataaataaaagtttttactttagaaacacatgagcaagctttgtaaggctaagttccttccatcgtcactagtcttctgttcatatcagacaatctcttacataaatgatgtacaactccgttctctttagtcttttccatggagtaattcaactctttttttcattctatctctaatcttctaatatggtaccatagttccaagtataattacccgacatatgatttctcatagtatacatatatagtcagtggcggatctagaaccataattaacccgaggcacaacatatttataaatttttaaaataaagtacaatatgaacatttcttaaaagacatgtaaatggaagaaaattttttgaagtgtcaatcaacattggcagtaccttatattagcataattccttcaaacagttatagaaaaagataaataaagtaaaaataagttaaatactgaaaacatttattacttgaaaatagtaaaattaatgagtaataaccaactgactagaaaaaaagtcactctaacatggggcacaacaaacgaattctttcatctacaatacaaattgcacaacaaacttcaaaattatcaaatcttgcatggggcacgtgccccagtacttatacacttgcgtccgccaatgtatatagtccgttttgtagtgatatgtccgagacaatgaatatctcacattacaaatgaaaatacaaggtatatagatctttccactttattttaagttacaaacaaacccgtgattcctgatataaatatgtgtaatggaatccgaattatgatgtccattagtacgatgatgaccattaattaaactaatacaacttgctttgttaaatgtatgtttttgcataaatgtgtacaatctatatttagtttttgaaacagttatataaaatttgaatgtccctatagtagcttacactaatatagctctatacaccaacgatcgaactatcgaagaaaattcttgaataaaccagtcaaagacgtccacaaggcacaaatattatatacggtgttgaagaaagcaatagagagaggtcaacgctttcctccaatttgttaaacaatgtataaactttacgtcaaaaaagtcaaaaccattcccttgttgcttattggtcattttccgacctatacgataatcttattgtttctctacgatatctttctgttgcattaactattaagccacacgcaaagtcgttttacattaacgttagtttaattagataacgttagtttaattagtattatttctacagagtaattgctttcgaaacttttgaaaacaatgtgccatacaggttgttcaaacatggttagatagatgcataaaattacaaaaattatatagagagaatattaaatcacttaaccattgtatcatgaggagatagcttgaaagccctgacaaagaaagagggttcataagttacctaaaaaagaaagaaagagagctcataatattttcatcaaagtaaaaactcaatgtggataaccgtcacatcaagacgaggcagatactagattgagcaaaattctccaatgaaatcacaaatgttgaagcactttaaatttggagatttcactgctttttcactcttagggtggcttacatttattaaagttaaggttatggggaaaaaatataaactttcttaagcagggttgaaaacgcaaaaacataaagaatgcacgtcgttgttagttattttctcccaaatgcgtgtggttttattacttttcaaacggcaagtaaaaaagtcttataaacgacgtcatttagtcgacttgatctcttttgtaagtcatcacatctttgggtcaatcacgaatttggaacatccggttccaaattacggattacacagaccctagcctcttccccaaatcccaattctccattgctttagaagaatcacaca

SEQ ID NO: 201 - DNA, 3000 bp, Arabidopsis thaliana
cctatgagcttaaccgaacattctaaattggtgggttaccgagcattttaatcggattaaaccgacttgaactggtatgatgaaaaccttcattgaaggaattggacacgttgcttacgagggggaaaccaaaacgttactccagttaaataatggcagaagtattttttgattgaatgtgatcattatttaaatgatactactataaaatgtgtaaaagaaacttgtaatgaagccaaacaaggccaaacagaatcattacgaagtggaagtataaaatgacgtaaggtctgaccaaccggtttctatatatctcagattttcaaaaatggtttttgtttcatccaatactaaaggcagtgtacttaaattcaatggaataaaagattgcattgtccgacggagatcccaacacaaaacacttgatgaatctttaagctaaacaagtaaacatttatatactctatagagtagaatacataaatagtaagtaacatttaatatggatcacataaactaattcaaagataagaagctgcagtttttgtaaaatacattcacagacgagatatcgtacacgacactcaccttcagccacatttcacggccgattggctagctacgtgaatgcatttccattctattcctttttttttttttcttcctatttttgcatgttaacttgagacaaaaagatgaatacatgcattaatgttggataactattttttttatagtccaataccagtctccgatatttataccatcttttaaaaacgttttattttagatcatcttttgatatttccattaagtagttcgaacctagtcatgctaaatctgataatatggagagatttaaccatcaaacaaatcaacttcacttgaagtcttcaatagatgctagctgattattattagtatttagtagtttatttttgttatggcgccattcattagattgtactacaaacttgtaagaatataaaagtgagacttgacttgagaggtagggaaaacaacaaaacaagaatgataaagacagtgaatatagaagtaaaagcaatgattcaatctcgtcaataataaaaaaaaactaatgaatgaaaatagcgtttataagatataatcttgaatcaaccaaccaaacattatctacaaagattattcaatgaccagatgaagatttatttctcggtaacttatttagcaacataagtatcttttttttttttggaacaaacataagatctatttatatctcaaacaaatgtgaccatatataattgttataataagatttctttttgggtttaaaaaataaaatcacattttcaaattttatttttgcaaagagtaaagaaaccttaaaacaactagtaccaaacatctttcttaaactctaactaatataggattaatgttctttttgcatttaaaatcatgtacgagactaaaacataagcaaaaatgtgtcaactaaaaatgtcaactatatcaataacattaaaacaaccttttaatactattttcttccataatactaagatttgaaattctaactttaatttgtgcaagtaaagttttgtagataaagcaaatgaatcacatgtttaaaaagaaaaccaaatggtccattgttttcatagccggctactttggttattagccgggactcgacgacttgccgtcgagactctcgtgtgagtccgtaattatttattcttcaactaaaatcaataaactattgagttataatcataatcgaatggtccagattcaagctcataccataccactaaatccatggtacatacaacgtagcagagtccttctctccttccttccctcttttgttttttcctctccctctcattttttttgttctctaaaccaactaaccgcaaaaaccaaaaaaaccccccaaaaaaataaaaatctctctctcctctccgtttctctctctgtcggagggagtgccggaatcgcgcgtcgacgggaagaatatcgccggaaaagctcaaaaatcatcgccggtcgcacgaattattcgttggaaacaacgcgtcgtgagaggaggggaaattcgaaaagagaaagaaaaaaaattgaaaacgccgattcactttttttatatatataatataaaaaatttcttttacggaattaaatattctgtgatggatgcgattggatagaaggaaacaaaaaggaaaggaggaagataaaagagagaagaaggaattattctcttctctcttctctttcatctctgtctacatcgctgtttttttttttcttcaaggatcgtgatacctgaagaagaagaaggtaaaaaataagagttaacgagatccactgtttgttgaaaatctggtttgaatttgtttaagaggaagcataattgtgtttgtttgtgattaggtaagttttcttatttttttggtagctggtggtgattagggtttttatttttatggtttaataatttggaaatggtttaattccgtgccgaatttgtgaattaggtaagagttggttcgctgtttgattataatgagctgcacaaggatccggtattaggcgaattctactcttattgcttctggatgtacctaatcgtctcttctagatatttctatgagcttaaaatgcagcgatttgatatgttttgcctctctagtggttgaagttgctaactttgttttatccttggacttcgcgtaattctagtagaaatcttctgtttctctacttttgtagttcttttgcttgatttttttggcttgtacgtgagtaattgagcacttttatgtgtcgtttttgcaagatcttcctcgcaattgagaaatgcattttgtttatgtagacactggttttgacttgaccacttttttttttttttttcaggttttttcaggggaagtgatatggttcgttgaaataagtttaaagttttaaaagattttgattctggttttattagtcaaattttgtaag

SEQ ID NO: 202 - DNA, 3000 bp, Arabidopsis thaliana
catgttgcgggtgtatctgttggtcttatcaccgatgtagatccatcaagtggtgaaataaaggactaccgtattgtaaccgatattctcgtgagttctcttattctaatttgttgtctttatttttatatggttagttatgtgaataatcatgaaactgaaatgtgtggcagtgcagtagttaatttaactgttgttgtctaaaccatgagtagagttaagttgctaaaatggattttatagaactgcatacaatgacttctcagggtttggaagatcatcttggagatatggatttcaagattgctggcacacgagatggtgtgacagcaattcagctggatataaagccagctggaataccgttggatatagtttgtgaatccttagaaaatgcacgtgaagcccgtcttcagattcttgaccacatggagagaaacataaattccccacgaggccaggatggggcttactctcctcggctaggtttttttcccacttgtcttttcgttaaccttagctaatagaatttcccctgctcaaactccaaaattatgtccgtcttgcagcaacgctcaagtactccaatgactcacttcgtaccttgatcggacctatgggtgtactcaaaagaaagattgaagtggaaacaggtgatttcttgacttcaactttaattgttaacagcttagttcttgtgacctttaaagactaaggaattgaataactcgtttgaattgaaaaatttaagtgcttttaagaaagtagtttcaagatgaaattcataaacttatgaataatatccacttgctttcttatagtttgctttgaagatctgataaataagtttttttgtttaggtgcaagattgtctattgataatggaacattaactattgttgccaagaatcaggatgtgatggaaaaggcccaagaacaagtatctttcagtcaattcagcttttaattgatcaatgattttccatgaattctgattttatgcatgtcctcaggttgacttcatcattggtcgtgaactagttgttggtggtgtgtacaaaggcacagtgtcatctataaaagagtatggtgcatttgttgagttccctggtggtcagcaaggtctactacatatgtctgagctatcccatgaaccagtaagctttcttagttacaaactgtgtccgtatgtttccccctgagtattgttttctcatgtaaacctaaatgttttcatctgccaaatcttagaacgacaatccgagagctttattttctttgccattactctagttgagatttggtttatacttaccttgtctttatgcaggtctccaaggtttcagatgtattagatattggccagtgcatcactacgatgtgcattgaaaccgatgtccgtggtaacattaaattatcccgcaaagcactgttgcccaaacccaaacgcaaacccgcatctgatgctggaaaagatccggtgatgaaagagtcgtcaacagtctacatagaaaattctagtgttggagagattgttgcaagcatgcccagtatcgtaacgccacttcagaaatctagattatcagttcctgcagttgtcatccgtactgctgtggagtgtaatgaggcagagaaatcttcccctgtgaacgacaacgacaaacccagacgcgctgctacatcaaagccagaccggaaacccaaatccacagcctctaaactgattgcgacacagaaggaagaggaggcactcgaatccattgctccagaagaaacttcagctgaatgtggtgagatactgaagcaggacgggaagctaaaatccgtttctcccaaaaacaatagcactgcttctaacctagtatcattttcaaaagctaagaaatcaactatgaaggagaatctatcagagaacaaggctgaagagagtgcatcggttagtacccgaaaactgaaaataggaacggagatgacagccacggtcgaccatgttcgagcccttggattggttcttgatttaggtggtgaaatccgcggtatgtacatattccaggtatgtttcagtaaattctcctttgacttgttctcccattttcttgagttaacttttgaggcgatatacttaattcttgctttgtattgatattgtgtactatgaatgagtacagggagataaagataagttcaaaaaaggagacacattgcgagtgaaatgtacaagttttaacaccaaaggagtccctgtgatggctttggttgacgaagagggagaagaatagtggtaaactctctttcctttctacaaggttttttcaacccaagggatcatgtggagtcgatcatatggatcatacgagagttttgcttgaaatgtttttatcatacggatcgaatcaagagatgctcgttagctgcttttggtgagcaaatcttggtagatggatagattcattggcgtcacaacttgaggaaagctaatgaactcggttaggtaactagtcttttactttggccttgtgatgtgccattttgtttctcttttattgggggggttttgtggaaccgaaagtggattgtattgtttagtgtcttagtaactgacgtctgaaaggtgcgtaacgcaagtttcatcatttttgtccaatttttacaaaaatacaaaagcaccaaaaacccaagtcggcagctaaagatagaaactacgcatcccaatggcattcttgatagatattatttgtccgaatatattttcttctaaattacaaattcatttcaacaattgacgtcaaaaattaatttaagccaagagacgaggaactaaaattgaatttcacattttgattgagcatttgggtttgaattaagattactcgaaagttgccaaaagtttgcctctgagtcattttattgttcatgaaagatttaaattcaaagataatgttcattgattgggtggtcgtgtaagtaagagtcgtcagcgagttttcttctccgagagta

SEQ ID NO: 203 - DNA, 3000 bp, Arabidopsis thaliana
cctgtgcacgtctctttttaaacatgactcagcctaagaatccaaagattattctcaacttagcaaataatgtttcatccaaaccaggagaaataagcttcactttttttttttttcactttctcagtcaccctaatgtatagatgtttcccggaaaatccaaacatggaaaacaagttctgagttgtgcaatcatactcaacatttgaagtcatagcataaacatatatctgtcactaattatagttactaacgctaacagatcataatcatcatcatcatcatgagacaagtctatgaaagtacactggaatggggaaaataactcaacttttgcagaaaagtttctattttgccacaacttaagcaacaatacaacttcacaggattcggagttttggaagcaacatataaatgttgtatactgatactcactattgctagtactcacaagtcacaatcatcatcaacattaaacaagtcaggacaagtggatttgtatgattcagatttccattggaaaactagctttaaaattccaacaagtgacttaatttcagatgcagaaatttgaataacaagacactgatacgattctaaacaaaaatccagctgaaaatgatataaatcgaagcagagggagaaagtggaaaaagagatttaaccttgatagatgaagaaggaggaagagagcacaatcttaagcgggaactgaatccaggggaagcaatccgatgtccgccaacagaactcgatttaaccggaaatgtagccggaaaagcaaaatctaaagcggaattcattatcggctacaatggaattatgaaattgagacgaaactactgagaatcgaaagatggaaaattcgaaatcgaaaagagattggagaaggtaggtgataactttggagggatcgccgttcatatgtctcagttttcgttgaggtcccataaccggactataccggtaagatatccgggtatctaaaccgagcccataaacatcaaaaaggatgggacgtgacagtaatcaataaatttgaattggacaaatggatccataaaaaagattatgggccaactttatcataatgaatgcccatcatcaattatttttgggacatctttttggagtcagcctcttgtctaaaggtggacgtcggctaaaagtgttcacttttaagatatttcagctccaattaaaaagagtgtttttaaaaaaacaatcagacactagtctacaactttatatgttaaggcataagtttaaatgatagctaacaatatatagattaaaggatttgttggtttgatgttagatagtatctgatctccatgagtaaacgaagatttttatatcaactagaaaaggtaaaaacaaatatcaccgtcgaaggggacgtacacgtacgtgctgattcttgtgttaatggatcgcttctactcacttagctctcaagcaatgaataacatcacaaaataaatgcaaagatgtaaacaaaagtaaagaaaaacaaaacgcgtttgaagaccgcgttgctctaaatgactcggtacttttttaatatttgcaattcacactcgtaataagtcctcttatctttatattttgttcgattttatttgaaaaattccctaaatatttttacaaaaatcgtgtcctaaatcctaatccttcgaccgactttctcgttttagtagtaaaagtcgaccacacttttttttcttttctttattcagtcgacctcattatacaattatctttgtgtgactgtgtggagtatactattagtttcctcattattaactttatcttgtcacactatactttccttttatattagcttcttctacttgtttctttctgtcttttctttttgggaactttctctttatgatcgtggctgtctcaatctatttggaaattcaatatccatgtatacttatttcttaaaatacgttcgaattaagatgtttcagcttatataaaggaagtaattttgagctaatagaaagccaaattattgaattaattttctcttaattacatttcaagttattctgccttgtgtaaactggaagtaacagaataaaggcggtggttgtggtttatactcaattaccaataactatttcacaactaataaaattagattaaaatgactgttatagattagagttttacttgttggaataaacaaacatcaattcagtactgaccacatcctttaaattagtttcttatatgtaagttaaccttaaaccggtaactgattacgaaccaaaccggaatatttatattattttttccatagttagtggcttaaggaatcagcactaaatactaaatattgctgggtcagctccttatagtaatatttaatttgtggaaaaagcttctaaatttatgtatcctttcgctaaccctccctccttcgtcttcctattcttcgcatacgtaatggaaagagaaaatgacgcacagttcatcgtgaagccgacacataagccatttccaaaacccaaatcaccctaaccccaaaacggcaatgacaaagtgacaaacttttttcagattctttatataaaaaaatagtattcctcaatcctctgtttttttttgtctctgacgtttgtcttcgtcaggtcttgttaaagtgtttgttttgtgtgtttgtgggtgttttcttcgcttcgtctcctttaaaagcttcgtttcgaaattcgatcccttttttgctttttcatcttccagatattaaaaaaggtcagtgctttatctttctctttccgcgtatagttcgtgtttatctaatctgttttcttcatgatctgttcttatggagtaaacccatttatagattctcaacaataaacccaaatatcttctttttcaatttgactctctgataaaaaaccaaactttatctgtttcttcgtttgctctgttctgatttgtttcttttcgttttttgttgagtttccaggtcttagctgattg

SEQ ID NO: 204 - DNA, 3000 bp, Arabidopsis thaliana
tactacacaaaaaaatactttttttattagtttgagttttaggatttatttatattcaaagtatgcttattaaattaataaatttgaattttcttaactttgttgtgtaattttttttttcttttttttataaacaagacacgattcatagtcaatccttattatgcgaagtaacacgacttagtagagtcaaactctggtaaaaaaggtagaatcaaatggatttaactacttaactaaaaacatattctcatttatggtgtaatttagttatcgaatttgaggaagaaaactaactttttgtttcaaaaaaaacactataaaaatgtttatgttatcattgcttcctctcttttaaaaaagaaaataaaattaagctagcgaacatttatgtgaactgacattcgaagacatccattctagtggcttttagggtttttcaatgctgccaaagcgaccaataaatatatttgtccaaaacctgtctaatacttatggttaataatgtattatacctcaataacaagcctaagttaggcttcaaactagctactatcaccaacctaaccaatttcacattatatcaaaataatcaattgtcagcgaaaattgcgattgccatgaaaattactcttctttacgtagactcaaaaacatttactaaaattatggcccaaaataagattactttcttctacgtgactagcattatccaatacattcaccaaatccacgtgcatcggattatcaccccttattttgttgtcgacaaatttgattctttgggttctttatttacaataatagtactacgtatctctatatcaacagctcagccactcgattacactagtacgaagagattctgttggttagatcaaattaggtatcacaaacctacggtacccattgttgcattagtatatagtttcgcaaaccttatccttatcttagcaccgttgaaattataaccgcgagataacacttatctgactcttttttttctaatcccacttatatatcaatcaatttcattcatttttagaatcacgaaatttgattatttgtcttaagtacgagtcatcaaccatggatagttaaatagtttttttttttttaacatcttgttttattttattagaattgaaagaaagattacatagttattagacacacacatataaccaaaagatgatttaagtttaagaagaagatacaatcgaacaagtgaattaaacaaattaaatagttatacacgatataacacatacatacatatatataacacatacatacatatatatatatatatttgtttacaatattatttgatggttttatataaacaaatattagtctatttacaggtaagtgtcttgtataaaggcctaatttgagccagttttagtcatgtgattgcattacatcgagaagagaaccatatatgaatcgattgctctcgtccgtttgcactttgcattattgcgttattttgttttcttggaattagagtttgtattttgtactgcactagccatgccagctaaatgaatataccaggaatcttttggatactttttttgtttatcaatatttttatttcggaccttaattaaaggaaattgatcttggtcggaaatatttatatattatctagaaaattttaaaagatacgtaaaacaagcttttcctttatgaaaaacgatcgattattatttaatagaaatgtataataatttcatgttaaaaaatgttaacagttttcaatagaaatatcggttacgttgcataaatatttatctgactacaaagtaacgttgtgtcaatatagagtaaatgacataactcctaagaatacaaaaggaataactacttgtcatgaatattggaataaagacttataacgtattttcaactatctcaaatcatgatgaatacaaagtagccggcggttttttcactaaaaaataaaagatggcggtccaaaattttatcaaattaatgatctttaatttttgtttgcatcatttattaaattctcatgtgtattctttaacgatgcaatataaaaattacaagcaaatcataagaatgtggatatgacgactatgtttgaaaagtcgtgatcggttgagattgcgttgcaaagtggtctactcagccaaaatacttcttaatcacatcaatcgaccttcaggtttggagttttctccattttcaattttttcgaatcctagttttattaattttatcaatcacatgtccatatttgataactgatatataaccatacataatatataaataatcaatttctttttaggcctaaaacattaggcaatgtccagattttgatggccgtaaaaaattattaagtagtattgttttttcgggaaagcaatgaatgacctaagttggtgattaattcaaccattatacgaacaccattgcaacacaatctcactcactttgatagttatggtttttttctattaatactttatgctgactacttttcatcgaatattaactataatagcaacattatgaactacattaatcctcaactccttgttattgtcacaaatatcatgacacgtgtgatttgcatgcctcgcgacgattacactagaaaattggactccaagttggaccatagaaaaataaaaacactacatacaaattgtagtaacatgaatatctcgtaaaaccaataatagtagatatagagttctttaaaaacactttatcaacttcgatttttcctccttgtgtgaataattgaatataacctcccccacttaatatatttcgcataaaaagacaatactttcccctacccacatccgcatgaaataaaaaggaatcttttattttccgaaatattaacaattcaaaacttccacacaaaaaaaaaaaaactacaattttctcattattatatcagaaaacctaacacacctcattattgttccacttcatacccatttgcttccttga

SEQ ID NO: 205 - DNA, 3000 bp, Arabidopsis thaliana
ctaatcccactatctctatcctcgcctatagctcttactgattcaaagctttcgtgtgcaagcttgtaccaaacttttttcacgggagcagatactccattctctgctgggaaatcggcgaagatagaccacgtcatcagatctggatcaatgagcatatccctcttctcaaatcctccaatgtaggcaaacgactcatcgcgaattgagacatctcctccatactttatatgcagcttcaaacaatcgaaaccactgcaaaaacaacaaagaataaggggattaagttcaaatgacacaaacctagaactctaaaaacccagaaatcaaacccgacaaaacccttaacctagaaatcgaacccgacaaacatagaaactgttactctaaactcagaaatctaacccgacaaatccagtaatcgatccagaaatcttcccattctcaatcccgacaacccagaaatcgatcccgacgaacaaagaaatcgatttcccccaattctaaccctaagaatcgattcgattacatacctcatcgtgacttagcagactcgttgaaatcaattaccgaccacaacgcaaccagttaaacgacgacacacatcgaaatcgatttggggtttcgaaatcaaagagagaattttagggtttcgaaatcaaagagagaattttagggtttggaatcgaaatcgatttgggggagaatgccaaaagggtaacagtgtctttgattagatcgaaataaacacgtggggttaagtattaacctcggttagacactccgttaacgaagttaacagtcgttaacccgagaagctggtttttccaaacaaaaactaaacgaaagattttaaagcgaaaagaaataaacctaggtattgttcgggcaaattaaataaccgaggtattaaacgggcaaattaaaaatatatggggtgtttttagggttttttccccattttatatttatcagctaatattcacttatggcttgctcagttcagaaaattatggaaatcgttgtaacccaaacctgtgatagtaaaaactgtaggcgatacctgaatcgggaaaagtttactttataatacttcggtttatttctaccgaaactgatcaaatcagccgaatgagtacaataaaaagaaagtaaaaaattatgaaaatcgccgtactatttaaaattttcaccacaattagaagcaaaaatctttagtattttaccaacatatatatatatatatatataaaatctacgaaaataatactggaatgctgaaataatgggatgtagtttcgtttcttggagcaacgtacttacagagctatatttttattttagtttttgttaacaggataataacaataactttatagatatttattgtttatatattttattattgttattgctctcgttgaaaacagaataataataaaacaagcctttttcttgttaacgacttgacgtattttttttctcttttcctattaattatcgtcacgttttattacgtttctctcattgatatttgtggaatctgaatcgtattagtcgactccaactcttaacaggataatgatgtttgaaaagtaaaatacacacttttttggtccaagcaggaatattttgttacgtaattaattttacatgtatgtcaagtggatatagtttacttacaagtctaaacacattatatccgtggtacaatatttcaacaattaatattcaatttttaatttgcatgtgttgtcctactttaatattgatatatcagtgtataggaaaaacttcaattaccaaaaccacaaaagaatgaaaaatcatacatcaaaaatcaaaaacctaaatatattggaaagtcaattatattaaaggtagatatttacttgttgttgttgttgcattgcaacttttcaacgcgtaaacaataactgagtagcagtgagcatatttggttattagtcttatcagaaccaaaaacatatatggttattgtcttttaaagatatggacccatgaactatacaaaagtgactatttggtagatatacacaaataacgtgacaccaactgagaaaaccatatgacaaaacaacacatataaatttaaaaaattggcttcgactagttgtagatattttgttccataatcgtattagaacgagagtaaacaataattgaatcgagtggtgagcaaatatggttatatattataacgattttaaagatttggatccatattcttaattagggaggttggtgggttcgattggtgtcggtctagtactcacaataattgtttcatctcaatatgattctgaaataaaatgttgaatattgcttacggtgttaaaagtatatgggactagatatggcatataacgtaacacttatacataacatcaataaatttagacaatacaaaggacagaattagtaagataaaattcacaagtaacatgacgttggctattttgtatgaacacacggcccaaatcgttcatattctaaaaggtataatacatttcgagatattttgcttcggttgcaagattttcacaacacattgagtcattgacagcgatatgagaaaatgtaacaatctctctaataagaaaggagaatcttataatttaacataaaaataaatataatattcgaggataatactataacaagaaagagaagacttatatgatgatgggcaaattgtatattcaactataaggacttaaggagacgccacataaagcagaaagagtttagaagaaaacgtttgttgaccaatgacttgatgactcagtagcatgtgaacataaaaagagacgtgcaagaatctcattggctgcagataacatctatttttgcttcactacctcaacttctctatataatgaagtaaacacccccaatggtctctttaacttaagtgtttctgtttaactccttgagagaaaataacttttaaactttagcttctaagagatattcagg

SEQ ID NO: 206 - DNA, 3000 bp, Arabidopsis thaliana
gagaaatggttgctagaatctcagaacttgagaagacaatggaggagagaggaactgaactctcagctttaactcaaaaacttgaggataacgataagcaatcatcgtcttcaattgagactttgacagctgagatcgatggcctacgagcagaattagattcaatgtctgttcaaaaagaagaggtggagaaacaaatggtgtgcaaaagcgaggaagcctcagtgaagattaaacgtttggatgatgaggtcaatggtctgagacagcaagtggcctcacttgatagccagagagcagaactcgagatccaacttgaaaagaagtccgaggagatatctgaatatctgagtcagattacaaatctaaaagaggagatcataaacaaggttaaagttcacgagagtattctagaagaaataaatggtttatctgagaagattaagggtcgtgaacttgagttagagactctagggaaacagagaagtgagcttgatgaggagctgagaactaagaaagaagagaatgttcaaatgcacgataagatcaacgtagcgtcttctgaaataatggccttaacagaactgatcaacaatctgaagaatgagcttgattctctacaggtgcagaagagcgaaaccgaagcagagcttgagagagagaagcaagagaaatcagaattgtcgaatcagatcaccgatgtccagaaagcattggtagagcaagaagctgcttacaatacgctggaagaggaacacaagcagataaacgaactatttaaagaaactgaagcaacactaaataaggtaactgtggattacaaagaagctcaaagattgttggaggagaggggtaaggaagtgacatccagagattctacaattggggttcatgaagagacgatggagagtttacgtaacgagctggaaatgaaaggagacgagatcgaaactctcatggagaagatcagtaacatcgaggttaagctacgcttgtcgaaccagaaactgagagtaaccgaacaggtactaacagagaaagaagaagctttcaggaaagaagaggctaagcacttagaggagcaagcattgcttgagaagaatctcaccatgacacatgagacttatcgaggtatgatcaaagagatagcagataaagtgaacataacagtagatgggtttcaatccatgtcagaaaaactcacggagaaacaggggagatacgagaaaactgtaatggaggcatcaaaaatactgtggactgcgacgaattgggtgatagagagaaatcacgagaaggagaagatgaataaagagatagagaagaaagatgaagaaataaaaaagcttggaggaaaagtaagagaagatgaaaaagagaaggagatgatgaaagagactttgatgggacttggagaagagaaaagagaagcgataaggcaattatgtgtttggatcgatcaccatagaagtcgttgtgaatatcttgaggaggttttgtctaagaccgttgtggctcgaggccaaagaagagtgtcgcagcgaacttaaggactcagtgccatggtacgttgtttatctttcccaagcctagtttccacctcacatgaatgcaaacaatgaaacaacatatatgtgtttattaggttttggactctggtcaatcaagaagctggtggagaggtatttttggttggggacttttggtgtacttgtgttcgattttgttgcacttttatatgtttgttaacttttgttgtattttgtaagtcaaaatttttggtttattgtgggcaaagttggtggtggtttttatgggaggtcagggaataaaggggctcacacaaatggagttgatatttttttttctttgggcgtcggattgtatagaacgattaaatgctactgttggtatagtgcttttgcttgtttggaatttgttatagtatcatctttgctctttcataacaaaattatacacatcgctttacagagtttcgttctctcattcatttcttattttattgggttttttttttttgcattagcagtcgttatatctcgccttgaatttctaatgtgaactagtttgaaatgtttgaaatgtttattctttaatagcaaccacttttttttcaagtgtttttcacaaccgaaaaagtcagccatgtgaatgatacacaaaataagtcagccagtaaggtttggtgatgttagatcaatcaaatatttgagaaaaaattccataactagttgatatttcctaaatcgaagttaattgaaaattaagtacaatttggcaatatcttaaattattaaattttaaatagaaactctattcacttttatgagtttatggaaacacactactttctcctctaaaatcagacagtgattatactttgaccttaaaatttgaaaagagtctaacacgttataattcccaattactttattatctgattaattcaccaagatacattaaatctaaaattatgtgatagatattcatataaatcatattggattattccaacaaaaaaaaaactcttaaaatttgtttccttatttacaaacaatacattactgaaaatttctaaataaaatatcaaaaagtaatttcaaaaccttgttttgtcaatttaatatttttatttttacaaaaaaaaatctgaaacatgcaaagaagcacaagtaaagtacaagtggaaatgtatgaaaataggaatcataaaactaattttttaatttaatgataggaatctgaaaaaagcaaaattttatcacatcccgaataaagaggaaaatgcaaaatatgtctccttttctcactatgacaggttgtttctttaaagaagcaacggaatttaacattatagcaaacattaactatcaccagctatcatgcgcccacctctccaccgtgctctccatcatcatcattccatatataaatcattcacttgtagaatcttcttctctttcacactaaaattcatcg

SEQ ID NO: 207 - DNA, 3000 bp, Arabidopsis thaliana
attgtgattgaactcgtgtctccatagataaaatgtccggtaaaaacagtcatactaaccggcgagcttccgatccacgcgccgataagtgaactcaatgttaaagcaatggatgccataaatgttgaagctgatatgctgctcgaaagaacagttaaagcaccacccaattcgtcttttcttgcctgtaatcattcgagctaaccgttatatctaaatccatatagcaaaagtaataattagaaaaatgttggcattaccaaatcatcattttttttatcttgtaataagttggacaaaacattaaatagaaatcgatatcgataattttgaaaagattgtcgtaaagagagatgataacttgcctgcatgatacggtcgacccaaatggatttatcgatgttcatgaaaccgataatggtatggtaaggaaagtaaaggattctatagagaagaaatagatggtaagataaaactatgattaatccaaatgggacaagaaccaaatctaagtactctttcttcacaaatatctccatcttcttcctttgtttctctacttctgtgctaaaatgtctgtcttgatttataatatatattcttacacacacataaatgttatatatatggatacgtttttatttttttgcgtataaaataaagagtaaggaactgagatggatataaagatttagaggaatcttagacgtatagaataatccactttgcttcatttaatctgagtcgacttttatatattaatttcacttatattaatatataattagatatgcctttggatgtaactgttttgaatagaaaatagtaatgagaattatatatacacgctaacactttattaaaataaactgcatgaaataggatgttcttcagtagtaacgttgcgtatgccacaaagaaacattgtagaagcaaaaaaaaaaaaaaaaaaaaaaaacgttataaaagttgccaattatgagtttgtgaccaaaagagtgaagtgtggagagatttggatatgggccaagacaacgaggctaatagaaacgggcttggcctatttaaaacattaaagaagaatcattaatcccttaattctacacaaatttttatttcgaaccggtctaccaaaaagtttatcctttttattcaaatacaaattttacaaataaatatcttaaactatatcaaaatttgaaacacatcctttttcttgatcatataaatttatatgatttccatttaaaaatccctaatatctaataatgaattataaattaaaattagcgccgagtcgctgactttttcataataaacccatatgagactacaatggagactacacagaaattatttttggagaaatcaaatttagtgtttatttttgtgagagagaccaaaatatgcgatttaaaaggtaggaaaatgattttgtcgtgatcaacacgaatgacaagataaatttggttgcatctcgatttatgagtaagtgagtaacacttcttgcatagacaaaagatttttggtccaataatcaaaatccataaaacatttacaatttcataaagatttaataggagcagaatcaaaactatttttattggagattatcggacataaaggaagaaatttattatagtagctagatttcatcgaagtcaaagattcgtaatgtatctctttgttcacgtcaaatatgatagtgtgaaaatatctctttgccttatatatccaacaatgacaatgacacaaagtaattaaatacacaaaaaaatacataaaataaaacaaactacaggcaggcaaatttgtaagaagatgcagtactattaaaaatattcaaactcatttgtcatgtatatatataattgcttctcaagcaatgtttttggaataatttgtacgcacgttacgacgaaacatagtataaaaatgtcaacatggctaattaagtttcgaaaatattttaataataaatataattaaaaattgaaacctaatcaatttacaagtggacattttaataaggagtttagcatcactcgtgagatttttacttccccaaccaaaaataatggaaacataattatgcaaattatgtaatgacacttatttctttctttaaagaattatgagttattattgtccatctactacaaaatttaaaagtagatgtactgataatttttttttttttttttttgtcgtcgtactgataattaaaaatatcatgccaaaactcataccaatgtccaaaacctgaataaagttgaatattattgccactcaaaatatcaattagaagactcatatttttagtccataattctatagtgaatcttttatctatttgtctttcgttttcatctgaattataaatgagttttggaaataattaccagttaaaattatttcttaatgtccaaaatgttaatagtaagtcctgcattttgtgactctgaatcaacaatttgatgtgtttttcttgtgtatttttctaaaccagtgtttatatatagatgtaggaggatccgtttggaaagtaagacatatgttcatctgcaaataattttccatgtgaaaacacatagataaaagggttgatctttgaatacatatagcgagcgaggtgtatgaaagacaaatgatgacgataagctagcacaacaatcattttatagtctctaataagtcaaaaataaacttacttcgtaataacatttctgcatattttagttatgttattattatgtacataaaggttagtataattttgtaaactcctggacgattaattactaatttaataactttcactttcagacagtaattataagtgttacgttgaaagattcgcattattcatgtgacccatcatctacttaatatgtatatatatgagacaaaagtgccgactctcttgacattaaaaaaaaaacagaaactaccaaacaaattagagagagaaaagaaagaaagaaagaaggtagagaggaa

SEQ ID NO: 208 - DNA, 3000 bp, Arabidopsis thaliana
agtaaaagataaatctgtagattaattgaaaatagtaaagcaagaaagaatggtataattcaaaggaactcactaaatcaattattgtttgctgatgtaataagagtttggtcgagagagataagaaaatggttcacgaagaagacacatgattttcctcatttacatcgtttcgtatcaataattaaagttagttgcaagacaagaggtcgttcttcatgatacattttggttaatgaaatgtctagcatattttaaaatttcaaatggtttagttaagacaatattaaaataaattatggatcaaaatgattccctttgtttttttttgttgcataggcttgatgattgtcgttggttcttaccacgtgggctttagtagggcatgccaagaaaagtggaccaaaagatcataaaagaaaaaagataaaagataaaaggagaagaagaaaaaaagataaagaaaaaggtttaaaaaaagagaaaaattaaaaacacattggaagatgttatagatttataatgcacatcatcaattggataaaacattaaaacgaaactgtaaccgaatattcgaggattctttactgcatgcatatataatttgttgttttcatgaagcactttcttcagataccttattattacatgcagctatgcaaaattatacgtttacaaatccaagctagaacatataaaatattcatttacatggtacatttttttctttgggtaccatggattgatcaagaacaaaaagttttaggcacatgtttgaagattatcattaaagcatatctatatcaagctacatatttgaagattaccatctcataaacaactaacacggattaaagaaagtaactaaagatacattgtgactataaattttgattgagtctcatattttgtagtgtgtaaaacttttctccatcaacattttgaagataatgtccatcaattttgtatagaatggaacttcttttcaataaatattcgtttgagtgttgttttcctttgatatgaataataaaaatgttttttaaaaaaaacttcaatctgaaaaatcaattgatagttaataaaaagaaggtcttgcgaaaaacttatttgatatgtctattgccaaatgttttcaatatgatgtgtctcaaattgactcatcgatctttagtttagtcctatttcttggaccatatagattctttggatttgttggactatgatatgaataaaagtatactaattagttcccttaagttatggaattaaaaacacattacaatattagagatcaatttaccccatacttacaatattcagaatttttattattatttttcattttaggacttatatcatccatcatgttaatccagtggtcaacaaaaaaataaattttaatcgattagattcattcaaattatcgattgaactatcatcatttctaaacaaatttgaccaatggctatagacataactcataagcatccaaaacataggctctattcaaaacaacaccttcttgcacaaggaggtaataatgaggtccacaacaatgaaaaaaaggaaaaagagaaagacatttagcctttctaggagtcaatgctttgccttttttttctttcctcatcttctcatgtttttctcaactttagctagtactttgtgaaatttctatttgatttgattacttctatacactaatttccaaacttcttttgcaatgagtgaatgatgatatgataaggtcgacgaactttcttcttccttggaaaacaaatttcaaatatccaatatgaaaacattaattttcgtacgtgagacataacccattcgacggtttcgttgaatcttcctcaaagacaagacgactaagcatgacttgacatatgcaggtcaataactaggtctttggttagagtttttagttggttttctctattttatatttagattaaattatgtataaatgatttcaattttttttttgttaaggatcaattagccagatgataaatccaattatccaactgtaatttttcattcatgaccatttttttggggcaaacattacaacataaatttgaaatagacatattaaaatttacataagcatttggaaaaaataattacaaaattgaagaaatgatgaagatctttctgatacatctcatcgagtgagcattccatatactaggagatcttcaacttccaagtcgaatcagcttttcttctgtttacaagaataactattcaacttgtatactcgtgaatacctacattaattctacagtctatctacaagaatcaagtagaacacaaaagctgatagaatttaatggataagacctatcaatatcatgttcatcatcatgaatgagtttcgtacttgtacatctactgcgtggattctcaaggctgtagattgcaacacatatgttaacacatgcccaaaaaaaaacaaaaaaacaaaaaaaaaatatattgtaaaagacatttgcagaaactggcctatagttgcaaggccgaagcattgggagaataaaacgacccacttaaaagccttgggcttctcttattcacttcaggatccttaccaactacttattgggcctttaataattaaagcccatataaaagaagcacattattcgggaccgaccaaagtgaagtaggtgtgttgtattctgatacgcaactgaaaatatagaaagcaaactcagtgtcgccgtacacgtggcacacccagaacaatcatctcctataaataccgattcttccgcctcgcgtcaacagaaaccaccattaaccctaatttttgccgaactcgtcttctgctgaaaaccctagatctacagatctcccgaatctcccaggtaaaaaatttactatttcctcttccacgattcgttgattctattatctctatcgtattctccacggtttgatttcttatagtttggatttgatctgttttctcagggagataatttgaag

SEQ ID NO: 209 - DNA, 3000 bp, Arabidopsis thaliana
tgaattttgcagtggactaaattcttaacaagaaaaggagatttttttttgtttatctttctcttttgagttaaatctttttatgcagaatgcttttgtctttaatttcgaatatgtggttttttggttgctcaatcaaaagtcattattgctggcgaaaggagtcgcgtgattcgcagcttcactgttctgtccgtcccaagacaaaaaattgcgaatttccaattttgcccctatattctctataatctacaacaccaccaatttgttttgtttttggaattttagatactcttcactagatctgctcttcacgaaattattctaaatataaattatatgtcaaaatttcaaaataaataaatactacacatagcttttactatatattataatttttctcgttatacatattcttttttcttttattttgtgatactaggtagaatctcgaacgtaatagatttatgtgatctctaattaggtgacgattgtcttttttttttctcatctatgttaactaattttcatttttgtttcctcttatattcgtacaaattctaaccatactagatactttatgtttgttacatatacaaataaaatgtccataactttgcttagtgttgtggatctaaaccactttttctagctaaattacattgtactatgagacaaaatctaagcgtgagattagtttaaggggctcgacgttattaatcttcataaaatagatcaatgttttgatgcaaagattaatataataatttatgtatcttcgactttttaatcattatatttagaccagggtggccaccaaacttcattaaatatatatcttattctgtataatgattagtaccatttcccatcaatttaacggaattatgggttgaatctacagataagcacgttaatactatattataaagttccatacttatttcggccaaggcacattactttgaaccaaagaaacatctaaagaaagacggttgattttaaattctcttaaatatgatatgctacgttattcatcgacatgatcagaattgtcttgaacattgattaaatgattatcatgaactattaagggacagggaagttttttaatgctcaactttgtcatggtactccttctattaaggcctatgacaataatatagtttatgaatcgaaactaataatctagaatttatgcattttatgtatttttagatatatatttttatctttaaagctagataaatgtcgatatattataaatttataatgtgttatatgttaacaataaaagtaactagccattgaaaacaaaatatcgtttctgtatgtaattgtaaaaaaatgttggatttagataaagattgttgcttttaaaacctggaaaattaattaacattttagacagttttgtgtattataaacggtcagttaatacaacttaaatgatctaatagatattcatgttttgtaaaagtcataattgtaagggactaattcttttgccagtaaggaagtaacactatttttttttaagctaatattaaattatatttaaaagaaataaatcaacgtatatataaattaatacaaattgtttttaaatatagaaacaaaataaatcattcttcattgtgtgtcttttgacgcaaatgttttttgaagcaaatcaatcttgtaagtctccttcatacttcaactctcacccatttatcgtacttaaatttcaataaaagcacaaataaactaaattttttttaaactaataatatggattctcaaaaaaaaaataaaaaaaaaaatagtaattaaaattctcaaatttcgaaaataacaaaaataaaaaattctcaccaagctcttggacgggagacaaggatattatagtcagtttcgcaagaagacgaaggtgtggggaatcatgcagtgctgcacaattcgaaattcaaaaaagtgggttgcatgttcttgaaccggctttggtcgagtgatgacaaaattggaccaattggtaaccggaagaaagaacaattgaataatcatatgattataatctgttctaagacaattctaaattcttcagaataccatatttttaagttttttgtaagaatatcattattagcaataatactctctatactgtacatacttcaaaatttatgttatcctttcatatttttttgagcaaaattttctaaattatccttatctctcacaagtcacaagaagaaaagtaaactatcaaaccacaaataattggtttttgttgagtaacttaatttattcaacaaaaatattctagcataaaatatatttttaatcaaatgatttctgtttcatgtaacatttaaaattaagattttatcttaacaattaaaattatcttccgcattcaatcaatcaacctaagtcaatggctaatattgactcttgaagagcttatattttaaatgggccttaaatccgaatcaaaagcccaataaagcttcgaatcatcttctccgatagtatcacatccttcttttcttttttttcctttcatcggaaaatttcagatgctcacaaattttgatttcacgaacatgagtttgcagaagaaacttatcttttacaaattacaaaaacgagtctccgtcgtgacggtcggcgacggcgatttcgttcctgctgcgaaaagattaaacgattatgtagaaaggattggcatggaaggaacacactaagtaaatcactgcagatactttgaattcaatacttgttaaggttcgtgttctcatttccttatttcaatttcgttgaaaattctgagagaacaaagcattattgaccacgcaaaagacgaaattgagtttgacgaagacgttttgattttcttctccactcgttgtgatttggtctgcaagaaaactaaatcacgttttctatataatttaatggtgctttctcaaaagtcttcaagttaattgcaaaattgaaacactgtttttgctggga

SEQ ID NO: 210 - DNA, 3000 bp, Arabidopsis thaliana
atgacttggcattttgtgtggctataggagtgtggccagagtctgaatcatttaacgacaatggggttggaccaataccaagccattggaaaggaggatgtgaatcaggagaaaaattcatatcaacaaattgcaacagaaagctcataggagccaagtactttatcaacggctttcttgctgaaaacgaaggatttaacaccacagaatcacgcgactacatttccgctagagactttattggacatggcacacacaccgcctctattgctggtggttcatttgttcctaacataagctacaaaggactcgctggaggaaacttgagaggtggcgcaccgcgtgctcgcatagcgatatacaaggcttgttggtatgtggatcagctaggcgcagtggcctgttcatcttctgatatcttgaaagcaatggatgaatctatgcacgatggtgttgatgttttatcactctctctcggcgctcagattcctctgtatcctgaaactgatctgcgtgataggattgctactggagcgttccatgcagtagcaaaaggcatcatagttgtttgtgcaggagggaactctggcccagcggctcagactgtgttaaacactgctccttggatcataacagtggctgcaaccactttggaccggtcctttcccacacctattacacttgggaaccgcaaagtgatactggtaatgcatatgtgtctgttttctttaatcaacgaaacacaccccaaatcttgaaactatctgattatgagtttttcaactgttaatgcagggtcaggcactgtatacaggtcaagaacttggcttcaccagtttggtttacccagagaacgcagggttcaccaatgagacctttagcgggtatcatcaaatttcgtgttccttgttaagacttacatgcaatgttcaataacagtttatgtcagttatctgacatttttctaaatatgtacgtaacattttgcagtgtctgtgagcgccttaatctcaacccaaaccgtacaatggcagggaaagttgtgttgtgtttcacaacaaacacactctttactgctgtatcgagagctgcctcttacgtgaaggcagccggtggtcttggcgtgatcatcgcaagaaatccaggttacaatctcactccatgtagagatgatttcccctgtgtagccattgattacgagctcgggacagatgtacttctctacatacgctccactaggtatgaaactataaataagtaatacgttatcaggtgtttcactccatccaagaaacatagaattttatgaaaagtagacaactttctgaatcagtaaatatcttttggctggatattgtggtttgcagatcacctgttgtgaagatacaaccttctagaacactcgttggacaacctgtggggacaaaggtggcaactttctcatcaagaggacctaactcgatttccccagcgattcttaaagtatgtccggatcctaattttcagattttctgcatcagatgttttcaaaaacaagaaaatgtaacgttttttgcaatgcagccagacataggggcaccgggagtgagcatattagctgctacatctcccgattccaattcaagtgtagggggatttgatattcttgcgggaacatcgatggcagctccagttgttgcgggagttgttgcacttcttaaagctttgcatcctaattggtctcctgctgcatttagatcagctattgtcactacaggttcttattttcactcaatcgcagaacaaccgatcaaaagcaaagggcaaaggatacacttgtctcaataattgtgttcactactttgcagcttggagaacagatccattcggagagcagatatttgcagaagggtcatctcgcaaagtagctgatccgtttgattacggtggaggcattgtgaaccctgagaaagctgcagatcccggtctcatatacgacatgggtccaagagactacattctctacttatgctccgccgggtacaacgactcatctatcactcagcttgtcggtaatgtaacagtctgctcaacccccaaaacttccgttcttgatgtcaatttgccgtcaatcaccatcccagaccttaaagacgaggtcactctcacccgaaccgtcactaacgttggaacagtcgactctgtctacaaggtcgtggtcgagccgccgcttggcattcaagtggttgtggcaccggagacactagtgtttaactccaaaaccaaaaatgtctccttcacggtccgtgtatcaactacacacaaaatcaacactggattctactttggaaacttgatatggacagattctatgcataatgtgactattcctgtgtctgtgagaacgcagattctgcaaaactactatgatgagaactgaatgattcttattaccttgaataaattgtattaagcaagttcatctgccttgctcatatgttaataaaccaataagacaaatcgacttagtggtttttgctttggtataacattattactcctcacggcattttccttcccgtgccgtatggccgccttgtatattgattgccgataatggactgtaagtaatcttgtttttaccatggaggctttttctacatagcttaggatattgggatggatgataccaagtagtgcactgccactaccagaagaaccaagttttttacagattctcaatcatcacataggagccacggtggctttatttgctggtaagctctgtcgaatcctgtcttgaatctaaactttctttaaactagaatatagttgaccttctactgagtggaaaacattctttagtttatatgtgactgaaatagaagaacatgcgaaaagaccatgtccaagtaatgtcaacattcttggagaagacatctatatataaacatgttcgtgcctcctcgtatagtttccatgtagattgaaaattaatgaaactttctttgtttgcttgga

SEQ ID NO: 211 - DNA, 3000 bp, Arabidopsis thaliana
tgatgctatcacattttctagtttgcttccatcagtttctaagtttgaaaaccttgagtattgtaagcaaattcattgctatattatgagacatagcatatcgttggatatcttcttaactagtgctcttattgatgcctattttaagtgtaggggtgtttctatggcacaaaatattttcagtcagtgtaactcagttgatgttgtagtgttcacggcgatgatctctggttatttgcataatggcttatacattgattctctggagatgtttaggtggcttgttaaggtaaaaatcagtccaaatgagataactctggtgtctattttacctgtaattggtattttgttggcattgaaactcgggagggaacttcatggtttcatcatcaagaaaggtttcgataataggtgcaatattggatgtgctgttatcgacatgtatgctaagtgtgggagaatgaatcttgcttatgagatttttgagagactctccaagagggatattgtttcgtggaattcaatgatcacacgttgtgcccagagcgataatcctagtgcggctattgatattttccgtcaaatgggagtttcaggaatctgttatgattgtgttagtatttcagctgctctctctgcttgtgcaaacttaccttcagaaagttttggcaaagctattcacggtttcatgataaagcattcacttgcttcggatgtatatagtgaaagcacattgatagacatgtatgctaagtgtggaaacctgaaagctgccatgaatgtgtttaagacgatgaaagaaaagaacattgtttcatggaatagcatcattgctgcatgtggaaaccacgggaagctaaaagattccctctgtttatttcatgaaatggttgaaaaaagcggaatccggcctgatcaaatcacatttcttgagataatatcttcttgttgtcatgttggagatgttgatgaaggagtccgcttcttcagatccatgactgaggattatggaatccaaccgcagcaggagcattacgcttgcgttgtggatctgtttggacgagctggtcggttaacggaagcttatgaaactgttaagagcatgccgtttcctccagatgcaggagtttggggaacattacttggagcctgtcggcttcacaagaatgtcgaacttgctgaagttgcttcaagcaagttaatggatttggatccctcgaattctggttactatgtgttgatttcgaatgcgcatgctaatgccagggaatgggaaagtgtgacgaaagtacggagtttaatgaaagagagagaagttcagaaaattcctggttatagttggatagaaatcaacaaaagaactcatttgtttgtttctggcgatgtaaatcatcccgagtcttcacatatctattctttgctaaattcgcttctcggagagctgaggctagaaggatatattccacagccttaccttccattgcacccagagtcatcgagaaaagtatatccggtttcaagattcattgagaaagaaatgagagatccagacaaagtatagaaaaccaagtatatatctcttttagacaagtttaaacattgggttaaatttatagaaaggaaaaaacgggtagaaaatttttcaagcgtggcctgcgcttgtctgttctcgtgttgaagcagttgcagagatgtaataagcaacagcaaagaggccgtgaacgaaacagaggatccctcctatggacagaacccgatggtgtgatatcccacagttttttctcgatcttgagtttgccatcgtccctactatcaacatcgaaaatgcaatcgccaatatgatcctgagacaaacaaaaagggatcttaatcaaatctctcggtagatttacagttgttctgtttatgtcgtgttttgacttaccacgtgaatatcagagaagccacagcgagctgtttattggcagaggatttttcaaggtcttgtcttgaggcaacacagagacacccaccaagaaaattagccgttacatgggctaacaccaaaaggatgcacgcagctaaaccgtacttgaaggctgtgtaactcgggtctctacactcgaatatccacatcttcaaatgcttcacctgcacccgaaaataaacaaattagtgaaatctgcatctcctatcgacttgtggctgtgtaatgtaccttgttctgagctatttcggcttcaatgccgagaattccagccgaaacatccatggctaggatcaagatgcagatgaagaaccctacattcctcgccattgtcgatgaaacaagttcttactagcaaacaaagaagcagaaagtattgttgttgaagtaataacttgttcttgtaatttataggcaattagagttttaagctttgagagactctcttcgttggatggaataagaataaagttcaacataagtttccttttcttgcatttgtactaaagatcatgttaagagaataaaatttagctgtgatcctctctttttcatgagaaaattttaacttttataaaatcatatttgatgtttctgaggaattgaagaagtttattagtaatgtgcaatgtcctcgaaaagatttgttttctttattcctctcttccattccatgtttaataataaaaccttttcaatattcgattcttgacagagcagccaagcaaagaagaggacgtttgcgttttgaatcgctgttgaagacaaaaatttcgttttccagtcgctctggcccaataaatttaagtgggcctttacagagacttatcctaaatcccgtctcgttgatgataatgacgtggctacgtacaaaagagtaacaaattcgagaacatgacgtggcatatttctctagaagcagctccattcttcgacttggacatttgtcttcttaaaagttttcgagaaatgttcgattcttcgagagttcgaattctcaggagaagaagaagaagaagaagtgaacagagaaa

SEQ ID NO: 212 - DNA, 3000 bp, Arabidopsis thaliana
gcgtctgtgaacgcagacgcggacgatatgctggcgtcgcggaacgttgatttgcaaacgctttatagcgttcaagggtgggacccttatgcgtgggcgtttgaagcggaagatgatcatgtacggttggtttttaagaatccgggtatggaagatgatccgacttgtggaccaatcatcgatgacattgctattaagaagctctttactcctgataaacccaaaggtaaccataaatttctctatatttctattttcgactccaaagttctaaaatgtgcctatttcaccctgatttttttggttacattttgtagataatgcggtgattaatggagatttcgaagatggtccatggatgtttaggaacacgtctcttggtgttttacttccgacaaacctcgacgaagaaatctcgtctcttcctggttggactgttgaatcgaacagagcggttcggtttgttgactcggatcacttctctgttccaaagggcaaacgagccgtcgagctactctcaggcaaagaaggaattatttcacaaatggttgagaccaaagcagataagccgtacatattgtctttctcactaggccacgcaggtgataaatgcaaggaaccattggctattatggcattcgcaggtgatcaggcgcagaactttcattacatggcgcaagcgaactccagtttcgaaaaggccggtttgaatttcacggctaaggctgatcgaaccagagttgcgttctacagtgtttattacaatacgaggactgatgatatgagctccttgtgtggacctgtgatcgatgacgttagagtgtggttctccgggtcgaagagaatcggagctgggtttgggttttgggtttttgttcttctcgttgtcggtttggtttaagtaactcaaaatttagatgttccggttttattctagtgtaccagtaaaatgttgttgcaaaccaagaagaattctgtatggtttatttatccatcgggttaaagcaaattcgaaggtgtttatcgttatgcaaaagcttgtcccaacgaaaatcgagagtttttttctatagttttattattttgttcgaatatatttggataaatctaccacaaacataacatcttagaaaatgtatgtatacagataattttgggtaaatcaacgtcaattcgaatacacacgtaccggagataaaaaatgtttcggtttagtttggtaaagaataagtaggtttttataattttgctccactgtttataaaaaggtgtcgtcgcattcagaattcttaaatttcttctctttgcttcttctctctccaccgccgtcgtcgtcgtctccgatttccataatgaacttcttaattttttaatccggaattatctccggaagtatcatgagtagatagatgttgaagcttatagaatctcttttttttttggtcccttattcgcttccatgaacatttcatattttggatctatgatttagagtaataggataagagttaatcatatgtttgttttgattctgggaatagtagatgatgaagatgatgacatatagcaggtacttaagagcagtctgtattatccttggaatgtttcttggtgcagctttatcttttgctatgccagaatcttccggatactcagtctgaatgacttttcaaatcagcttctttctgattcactcatctactagttcttcttgatttaacaatctcaatgtttgtttctcggatagttttcactccaaaaatgaaaaagttttcttcttcgtgaggatgtaacatccagtttaggtttgtttttttagtgttaatatatatgaatgttttcttactgcaactttatagagcagccaatgtttgttggttgtgtgattgattagattcagctataatgcttgttctttatgtgttatgaactatagaggaaaaaaaaacagaagttggttgcatcctcatgttaatggtgttttcttcttctttaaccttgatgttatttaaggtatattgtaaaggaagatgagtatacgtaaataactttatatagttagataggtattccatttacactctttacagcaaaagttgaaagcctaatgccacattggttaaagagaaactgtcgtcctatcagtttaaaccaaattgcattcgaatttgttttttgagtgtataattaatatagattaccatcgtgctagaatcctactgtgttgtcattgaaggagaaacagagcttgcagaggccaaagatgtgtggactcatcaatttggaggactgcttctccaagtcatcgtctgctctacttggaatagcattgttctgttgttgtcatcacactatcgacggagaaacagagcttgcagggtctacattgtacacattttttatatctgtatcaaaggacgtggaatagcaatttatgaggacgagagatatgagactgagaaaaaaaccattatattacactaaatagctaaagaatatttcatcacaatgcctgcaaaagaatgacctaggatagcttcatgttttgtatgatccattcaccccccaatcatctaacaaaggattagctacaaaaaaaacaaaaaaaaaaaacacaataaccataaagagttgcaaacttggacaaataaacagttgatggaggaagcaaaacattgaccataatcatattcattgaagtgttaacaggcttttgctacggtcatattaaagtatcatcaagcccattttgataaaaatatggaaattggggcgacccggaatttaaattggatagtatccgggtcagctatcccgtgtcttttgactccttccctcatcgtcgtctctttcttcgccaagtctcttttctcctcgtctctgcctagccgataaattcgccgttctccatcggtaaacgcagctgaggagctagataattctctgatatctgcgttacgccggtgtggaagcaaaatttaggttaatcggatctcaatt

SEQ ID NO: 213 - DNA, 3000 bp, Arabidopsis thaliana
agatgatgcagacttttaaattgttagaacaaagtttaacaactatatataactgatcagttatataaatagcatatacaccatagtgatatcttcccgatcttaaaagatattcaaattatcttgtggatatgtacttgattcgatatctttgattttttgtattcatgatcttatggttaggatcgatgccaccagttcctatgtaaacaaatagataatatgtaggtaaataacattgcttataccaatctaaatgtcagttaagaatatattgatacatatgtttataatgccttacagatttatagaaaacccatatttgattatagtgatatatataagaacgtatacagagagcgcaatctcttatccaaatcagaaaaagatttcaattcgtagccaaaaccaagaaagatataagatataggtgaactataggagggtgttttttttactcgtaattccttggattctattggttaatccatcatccatagtgtgtgtatatttaatttttagaaaattagaaagaaaaaaattgtagaaagggaaagctatatagaaatggcaacccatgcatgattgccttgaacatcgcaaaccctcccttagattgcatgtctagtggaacatagtggacctgcaacaatattcaacaaaaaattcatattatatacattgcataatgcatagtaggacataataagatgaattattatgctcaataacaagtttatatgatatgcccacagtttcatcacatatacttgagtttattaaaacgaatgattctatttctctattaagattagcctttattaattgttagtggtatgagatatattgaagaaaataagtataagcaaaaaaaatgttgatagaagaattaaataagcaataatttcaaaaggtatgtaatgtggatgaaacggcacatgtcgttgtcacgtggctcgttcccatcgattcaatgcatatctcgaccaacttgacttattaatattcctcgtacaactctccaatctaaagccacctttcttctacgttatacattttctttttctgttttcttttaaatactttctcctcacaaattattgttttctattatctaaaatcaataccgttaggaaatggtgtctttataacactttagaaaaatataattaatcattttctaatgtattatttttgtaattgagtaatttgatttaaaaatataaactaatataataatattggtatttaatcatttcaaatattcttaattatattctttttgaatacacgcatattgttctaaactattaatttcttacaaaaattctatattatttattgtgtctacaaacaaaagagtcgtctaatcatttttggtttcattttttttttgctagaaatcaaaaacaaattcctcattttttttgaggtaagctaatgttattttctaataacaatcataagtaatacccgtggtttaaagtttacacggtattaattaggtactacagccatggtggacggtggatcttcatcacctaatccgtacaattaagagacaattaattacattaaatcatgtgcattagttgatttaggaactaattgataaatcaactctaaagactaaagtagtgcgatagataaagctaaagtatatattttcttcagtataaagataggaatatatggggacatatacttttgtcgattttgtatccagctttgcatcagtgaagtctgagcgaagatatgaccagacttaaaaagcaactaaaaagatgcataacagaaacacaaaaataaaattcatgcatctgctagtcatagaggttattggattcattgcacgtatcttaatgattcgttttcgtttcacctcccttgctacaaaagatttgaaagagaaaatgttaaattctttaggtcagaatcaattaagataatttcattttcttcttgtgttttgtacgtcacttgtttcttttttcgttggttatgtaccaaaacatgaaaagttcaaaaattgttaattagaagattaaagagaagagtaagaataaagatgaaatgaggaattgatatggaggagtaggacccaagtttgcaaggatggtggctggctggctgctctgttgtttgttacatctcattctcaatcttaattccaattctatgtgcttctttcactatttccctatagaataccattcttgtttttttttttcaattttcaaaaaccactataaggaactttttcaatagttgcttgtttgtttagaccaaggaagatgtcaaatagatttcttcacttttcaagtggaagcaaaattatgcggtcaagtgtattatactagtgtgtgtttttttttggtttaataccgactaatttctaactctaatctatcagtgaacgtcttaaaactaatattgctgaagaatatattgttctctgctacagcctacagcattcaaagtttcatcaaaaagataaaatgtatatataactaaaagttttgggttaatagataatagtcaaagaagacattcgtgttgaatgtttcttttttttttttttttttatcgtggggattgattcaatgcattgttccaaccttttgactctttctcgtgtttccttttttattcgttttctgaattatactttttagaccctttcctcgaatttttacttgagccctactctagtaatacataagcatatatataaaaatctctcaaatttgattaggacagttttagtatataaaaaaaggaaaaaacgcattgtttaaaacgtggtcatgacgaaaacgtttgatttcgatcgatgatatttaaataaaggaaacacctaaccatatttattcttaactgatcaaagatcctccaatttcacgaagcctaaaactctcaaaaacagattcaataacgtcaccaaaccttgaggctttttaaaggaagaagcatttgagaaaatcgtaacttcttgaccct

SEQ ID NO: 214 - DNA, 3000 bp, Arabidopsis thaliana
aaatatctcaaatttgtttttagtaaagatcaaacaaaacacatgtcgaagctatgcgagagaagaatccatctactttttgttcaacaacactgcttttttaatacatagcaaatgattaaagtttacaacacaatcaattaatcaaacccactaatctagagaagacttttacatgccccagattcctctagctgaagcaactctgctattagatctagcagtgagttcatacaaaatcctagcaaatgaatcagaatacttaccctcttgaaaaagcagctcagcgaaagcattctcatacgcgagtagcaatcctctgttttgaggctccgagacaaggttctcaaggatcattgcagctttcctacatacttctggaaccggatgcggagtctttatcactttcagcaacctatcaaccgccctgaaaaagatcataatggtgtgtcattgttgcgatctaaaaacagtttgattgtattcgatagagagggagtatagtttttgtttaccatctctcacttgctagctttaatctgcaatccatgttaacttccacgagattgtagagtgctccaacagctgcagcttgtgcatcaacggcttgtatgctcaaaagatcgattagtcgcttgtgtatctgcaagggataggtccattgttgggtttaaatactagttaaaacgagtaagtagccagaaaccatatgaagattatagaagttaacaaacctgcggaattaaaggactaatgaaaggttcattgtccggattgattatcaaacgccctagcaactcagcagcagcacaattccaagctttgacagaagaattgaggattccgaccacagcttgaacagctttcttttcactatatgcacaagagtaatgaatgattcacattggtatttgaaacaagttatggattgtgtaactaagaatgcagggagatacaacttctcactttatgttgatgtatgactgcttaagcgagctgaaaattcgaagatccatcaaatgcgctaggtttacaattgtctctagcgagtttgtgaccagctcttcatcctctgttaacaaaagattgtcttaagaccatagttcccaatcaagtatcaagcaaataaggaaacagagagaatacattcaagccaattcaaaccaataagaaataagaatctatcagaagcaaatgtaaggaattataactagtaaaagaaacaaaaaggttgggattgtatgtatcaaaacattagtattcttccttaccggtcatatgatcgtgtatgcactggaaaacagtttctaagcaatggcgatgctgagccattacaacttcattatcaggcatgaaggagaagttgcggataacgttcgatgcagcaatagcacacatttgtttctctgatctcccttcatcgtctagattaaacaaaccatcctcttccatccaccactgagatgactgatgtttaccagtgctcttttttcctaatgcctcagcagcagaagaaccaatcccggatctgctaggccaaatattaacaacacttaggttctaattctaaatataagcaacaatcatttaaaactgtaatcaaagcagtatcgaaattagctcacccagggggttgaatagaggctagagcatcatactcattgccaaatcccgtaactgaagcatttgtacctaaagttctaactctagttcctcttgtcaggtcctttgggagagctatgtcacgccaatcatctatctgccaaagttttagcatcatgttggttcaaagaacagagaggaaaacacaatcccaacacctaaacaattaaataaactcacaattaagagaagggcatcaagcaagccagctatcttagcaagaggcatgacatctcttcgaatatcttctttttccttgaaggaaagcaacgtaagtgtgttcaatgcccatgtcacctcactcttcaaaccactctgcaacgcaagaactattcttctattgttctgctctataaattccaatgatcccaatgaaaattaccgattaaaaactcgttcacaagaagaaaacagagaggaattatagagtggtcattgcgagcttaccgacgaaggaattgtgaactagaagagaaggaccaagtaaagctgacggtgacatcgcgtccgctgctgccgccgctgcagcagcagcagctgagttagcacttgtactaccgaagggacggcctctcttcgctggtggacccgaagatccaccggaattaccgccggatttcccaagctcccgtttctgcatctctctctaatttggggctaaagttagggttcggaaattttgacccgaaagatttattccggtttaaaagtcccaagacgatttaaaaattaaaattgtttaaagagcactaaacactttttgtgagtcagagggtttcggtacaattgaaattaaaaacgttttagaccggtttattccggttgaagagtccgagactataattaaaattgttaaaagagagcactaaaccgtctctctggtttacagggttccggtttaattaaaatcaaaaacgttcacgtcttcttgtatatgtttatacagacaaacttgcagagggaaatcgccaaaccctgcgccgccgttgtttcgccgccgaagcaagtttcgcaccattcttcttcaaacgtctgagctccatcaactgattaaggtgatttttttacatatcactcaatttttgaatcgaactttttaaaatattatggaatcttcaaagagcatctctctcgtttttatctctctttgattcttacgagacgtgcacaactctgtggattcgattcaaaaattcgtgagctctcacacaaggttttaggatttggattatgttttgttgaagttttctctactaatttgaatcgcatcgattctgataatgtaatccttgtatatattgaatctgcaggtagctgtgtgttttgtaaattgaagag

SEQ ID NO: 215 - DNA, 3000 bp, Arabidopsis thaliana
atgtaagtaaaattgtgaatatggaaaagaaacagatgcgtgttaacgagaacggttgagagagatcacttgagcttcgcacgtgaatgtgttgggattggaccctattgaggttgcgaacttgattcgctcttagcaatgtttttgaaaccggactgaaccggctgatcggaccgggaattgttgcggaaaacacggtcaaaaaccgacatgcccacatcccctaaaacaaaaagtttaaacagagatggtttatttttctcctttctgtgatttcaattatacggaatggtttaattccaagttcaaggattacacaaaaaaaccaactcaaatgcaaggcgatatgacaccacggagttacaaagtagtagaatgacaggaaatgtcaaatgattgttttgcggtttaatcttattcgggatcatatagagaaaaacaaacaaacaaacaaacttaggcctttgtagctccggatttcacaaggttttcaagggcctttagaatctgtggctctgtcagaccatccaagtttacacacctctccacacccatatctgcacaagccaagcacgaattaacgcaatacaaaaacagacacatttataaatactagttccgaagtagaatcgaggatgacaattttaacgcatatgactgttgcgtaaaacaagtttatcaccaaaaagaaaaagaatcatcttgttctctcatatttacagtattatactttactacattatcggagtgtgggaacatagtttaaagatgttcaaagttcactcaacacagatgcttaaatactttaagttgctgaagacactgatatgtttggtcagggaaaccatataaaatggatcagctaatgagataacataaaccataagattttggcattcacataaatacacaacaaggaactagggaaaccagtctcatttcaaaagaacaagccaatatgcattttcattaatgaccaatagtctaagggtgagtgtgtactttaagagtaactcaagatgttaaaactcactcaaaatttaaggctgatatgcgacaaccataaagttcaaaacaaaacaaaaacgagagagagaaaatgaacaacagcagtaggcaatcacataaaccataagattttggcattcacataaaacacaacaagggacaagggaaaacaatcctcatcttataaagcacaagccaatatacatagcggttatacacaattccttatcatcaatgaccaagactctaagggtgagtgtgagtgtactactttaagtgtaattggttaactcatagtgttaaaagactcttccctaaaaaacttaatgcagaaacaaaagaaagaagccacatctgttattaccaatgaccacattcatgtcaagttttttaaaaacaaacaaaccaaaatttaacactgtagaaaattcaaaacaaacagaatcgcgagaaagaaaaagaacaacccacattagaaaatcccataaaccataaatttcagcattcacatcaaacacaacaagaaacattttcatcacaagatgtacaaggctcgatagtgagtgtataatgggtgaacacaagatgttataaagacacctccatacaaaatatgaatgcagaagcaatagaagaagtcacatatgtaactacattcatatcaaatctttaaaagagcacaattaattttcatatctctaaaaattaaacaatttgagtcaaaattttccttcacagagataagagataaagcaaatttaccatatcttgcccacatctgaggctggactccactacattcacggatcaagattggtaatttagggtttagagacttcaaatctttgtaattcttctcaacaaacgttctgaaacaacgaaacaaaaaccctataaatcacaaaacggatatggaacattgaaaaaaaattccgatctcagagattgctttgatcaaattgaaacctggtgggagcactagctggagaagattgacaaagaagaatcctaagctctttcatagacttcgatatgcttcctctccatgccatcgttcttcttcttcctcttaactcttcagatgccacacaacgaaagaatcaaagaccagagagaactttgtgttcatgtgaaaatgaattaagtaaagttattggtcttcggcccattaagtgagtcggaaagttactgggcttaggcccattaaatgagtcggttttgttaggtttagaccaaaaaaaaaaaaaaaaaaactaggttatatatattctctttctctgccacaaattgtcttcatacagtaaagaatataataagttgtcgaaggcttgagcgttgttccttcttcttcaggtactttttgatcttcatcttttttttgggttttaatttgtccttatgaattcgtaattgtttgatttgattattcgatttgatcgattgattctgtgatctgatttgttttgcatgtggttatcgttgttttaggtttcgggaattttagattcttaagtatacttgtttatcggcttttctcgttttgatatcatagcaatcgatttcgtgtgttgaattaattttaatctgaattaagattagttattccgtaatatagaattgaagagattggtttttgtaagacagatccatcagctaaatctattattgtcttgatctttgaaattaatatgtaatattttttgtattattaatttcttttaagatttattagtatcattattcattactgatgaacgcatgttattaagattattgaatttaattcaacttttatggctgatttttttaatggtaaattgcacaatatttattgtatgattaaggttacatgacacactttgtattattacagcttcggttattgtttcttgaggattttatatccgtattccagttttgagttatattactctgttttcggtattaactagcttatgtactgttgttgtaggtttttgttctattgttaag

SEQ ID NO: 216 - DNA, 3000 bp, Arabidopsis thaliana
tgtgagtacagctttttgtgctgaaatcgttgaatctgcggatgcttatctgtttgcaggtccgattttcaacgattacagttctgttgggtattctctgcttctcaagaaggagaaggcaatcatcgttcagcctgatcgggttactatcggtaacggacctgcgtttggatgtgttcttatgaaggattttctaagcgagttggctaaacgaattaagcacaacaacacttcttatgagaattatcacaggatctatgtcccagaaggaaagcctttgagagataacccgaatgagtctttgagggttaatgtactgttccaacacattcagaatatgctctcttctgagtctgctgtgcttgctgagacaggagattcctggttcaactgtcagaagctgaagctccctgaaggatgcggttacgaattccaaatgcagtacggatcaattggctggtcagtgggtgctactctaggctatgctcaagccatgccaaacaggcgtgtcattgcttgtattggagatggtagtttccaggtaaccgcacaggatgtatctacgatgatacggtgtgggcaaaagaccataatcttcctcatcaacaacggaggctacaccattgaggtggaaattcacgatggtccttacaatgtcataaagaactggaactacacagcttttgttgaggccatacacaatggagaaggaaaatgctggactgccaaggtgagatgcgaggaggagttagtgaaagcaatcaacacggcaaccaatgaggaaaaagagagcttttgtttcattgaagtgatagtgcacaaagacgatacaagcaaggaacttttggagtggggctctagagtctctgctgctaatagtcgtcccccaaatccgcagtagagtatataaatgcactcaacttatatatatttcagatttggtagtgtcttcaccgttctatgtaaagtagtgtggatccttttacacccatctggatgggaaaaaaatgtgtgtccccttgaggatataaactgtttgagtgcctaaataagaacttgtttcctctgcttcatctttcgtcctcagttttacgcagatttatcagagctatagtctttgtgtcttggattggtatgttgattgacttaagaaagttgagatcccatcccaagatgccaaatgattactttaaaggcagttggtagagtcctttcttttcccaatttatactaacttttgttttaccttttcttgctttctgtttttttggttcatggctaaatttgatcttgtttctatgaggaatgcagtgaggcgtcttgggagtgatccactggtttacaaaacgacttcatcgctatgctgttgtaatgtgacgaatctttcgctgttggccataatttatgacttaagtaggattaaatagcttattccatagtaactcccctaaatttctgcatagagaaacctgtccaaatttgtgatgcagcttgaattcgacaggaattggggttaatggccttcaagtccggtgaagatgcagaaacccttggactaactggccatgaactctacacaatccaccttcctagtaatatcaatgagataaaaccaggccaggacataactgtgactactgacactgctaaatcttttgtctgcactttgcggttagacacagaggtaatcacaaaagcttttgtttagatttgattgtcaccatatatttaatggtctgacttggttgattggaattgatcaagtggaactaacatactataatcatggcggtatgctttcgtatatcattcgaagtttgagcaacgagtgagtgattttgatttaaaaacatctcctcgcttgatctagatttgggttctttgcttcatcaaaaagcaagtaaattcggtgagtgacaatgtgtaaaacgttttcaacataatgtatcagaacaatctgcaataagacgtctcttcttttgtcagacaaccacagatatcgaataaaatacgaaatcatattgacttcgagattcttctcgcaagtgttgttattggacccacttgtggctcttattatctttcttttaataaatgctcttaatgggcctacacggatatgagagttgcgcgtccattatacgcaaagaaaatagataattattctctgcgtctcacaccagttattctaaacgtgaaaccttccccacttggtcactaattcgaacttatccatccacgtgtctagaaaataatagatctacggctaagatttagccgccataaaaagaagatctatggtaaaaaaaaaaggtctataaatacaaaaccttccttaagctttcttcttcatcaattgaattaacaaaaactccaaagactccatcgaacaaaaccttcaggtacgatttgttctttcttttgtagatttgatcgtttcgttgtttgttgttctctgtttgattgattgctctctagttttaattcgatttagggttttgaagctttctctttgttcgttgtttcgttttcgaatcggattggtatgattttgcgttctgtttttcttatcttatggttttgatgtgtgatttggatataatctctgcataaactatcgaatctcatattaaagcgaattgatttacttgattgttatggttttgagaagtttgatctaaattttggattgtctcctctcaaatcattttattggtcagctttagggtttggattgagattgaattcgaatatatccatgatccagtaattgatctatatagggacttttcgtatgttataatctagttatatgttgaacatcatgatgacatgatctatttggttaagtcatgctctgttcttgattaattgttgttgataaagactagatttgtttattgttgattggagtctaaaacttgggttttctcaatttgttttgcagagagaatcaaacagcttaagggcagtttcttagttaaaagtaaccaagtttac

SEQ ID NO: 217 - DNA, 3000 bp, Arabidopsis thaliana
acttccatcgtcacgagatcctttccactgaacgataccgttttgaggctcatggacaccattttgcaactgagaaacgccgccggtttgccattgtggaacatcaccgttttgcaactgaagaacgccgccgttttgccattgtggaacatcgctgttttgcaactgagaaacgctgccgttttgccaccaatgaggaacgccgccgttttgcaactgaggaacgtcatcgttttgccactgaggaacggcgccgtgttcccaatagtgaacacgatcatcgacgccgctagctcggtgaatgtagccgttttccaactgatcatcgacgccgctagctcggattatatgcatcttcttctgctccgagacaaaagtctgtatcgtcctacgaaactcctcgccgctgcttaaaccatccatagactgcgacctccacgaccccgttttcgtcactctctccgtttccgtcttccgatactccaccatcctctccgtcatcttcttctccgatctgctcgtcctcctgtaactcttcgaactcatctccaccacttcttgatcgtaactataactactctcctcaaccgccttaaccgcttgaaacgcgggtacattctctctgtaagtcgagttattgtaatatccaacatcttcaaactttgacatattataggaatcgaacggcgtgacggtggagggtggagggacggcggctacatattgatcgtaaagatctggttcctttttttccgtggtttggattttgctaaagataacgtaaatcaggaagatgataatgcttacgacgacggaaaggaagaaaaggtttcttagaaccaaagtaaaccaatcgaaccaaatgaaaaacccgtgcagttggttgacgatcaccggtaaacaacagtaaccgaaggctacgacggcggacaatccaacggtgtatttacaattctggaacagattctcgtatgtccaactcgcctctgctttctctgcctccatttttttttatatattgaaattgttgagatttattatggtgtattttagtatttatagatatgtatgtgaaaatgttagaaagaaatctatagaatatgttgcgagaaaatgaaacgggcaagtgaatatatatgataaatgttcttgggatgttaatcggattaatgaaaggaaagatgggagaaagaaaatattctggttggagaaagagacacactgataccgagatggatacgatcaccagtgtggtcattttatagggactttataataaattaatatgattgcataatggtcatttagtaatgtttttgctttgctatctcaaagttttaatattgtggtcgctcgaccaataatgtcccaattttcctatgtttttagctaatgtgttaggcaaattatatggttctttttaactttatgaaagaatgttttgcgctataacatttctgattaggagtgttttagtatgtgcatataataataaaatatagtcatagattacagggtttataatcgaaattcatatatagaagcatgtaggttaaaaggttaattaccatggtggatgtttaacataaattctttatctaggtaccttggccactatatggatacttagtgtcaattaaaatgtcattgcaagatatatatattattacttcaatctatattattggcattgcttgcgttggtagatcttttggttttaataaaactagaacttttccattttatatacacatacatatatagatactattatatccgacatgttcaattgatatatactcttaggttgcagaatatttgtaagatctcatatcgatccagcaagtttccgatataaacacctcattaattagttttctagatttgggtgtagatattaattaactcgagctgttttctgaatctttcctaaagtaaaatgttcctttgcatctacatataactacaactatttaagtttctacaaagcaacaatgcctatctttaacaatatacaaattttacaagatatgtgtagtagtgcataggcgaagaacaagaagtatatgtaaatagatgttggtgagcatgtataaataaacaataaagcctaaattccacttgtaaacccctttaagcagacacgtgaaagtcacgcgccaagaacaaacttatccacacataaatgcttcagaattactgaattagtatcacaatcacgagggtcatggaaatcgcaaaatcaagaaaaatggtcgagacccgagaatcacgtgagatgagatgagtcatgtgctcaaaagcaatttcacagttgacacataataataaagatggagtgtaacattttcagtgaatagtgatcaatgttgaatccatttatttcagaaaatagattagcctaaaagaaattacagacaagactggtttatgtatgtgcagagccaaacactctctgattctgtggtcgctatcaaacaatctttgtcataattataccatttttttttccaaaaatatcaagcaaataattagatcgtacaaaattaaattaatttagctgttacattcatgctagacctaatttgcgatgcttagttagattcatgtcctgttttgaccaccatgcactttcgttcgaacagtttttgactatagactttcataattttgtgtcttcatttacgtttatatatcgttattagttgcgtttaactttttgtttaaggcaaacataaaatttgaactaataacactaacatgtccgaacaaattagacgtcaaaagtgtatcatcacaaagtctatagtcaaaacttgtatggataagaatttggataaatagtaggcttcatagtttctccttgttcacaccatacaaaatacaaggatagttctagagaacgataatcgttttacagtcaaagattaaacgggtttttaatacatttgtatataaagagctctcagctagtgaatattaaccatacaacaaaaagtc

SEQ ID NO: 218 - DNA, 3000 bp, Arabidopsis thaliana
gcacaattaagtacacgatattaatcttctagctgcaaatctcattaatttcccatcaatccaatgcaggttgaatatgtattaatggagagaaagcaggaagatgcatataaagaagccatagaggagtatcgtgctgcttctcaagcacggcttgtgaagctttcatcaaaatccttgaattctttagccaaggcacttccaaagcgtcaaatttcaaactattttactcaattccggaaggtaattctcagctactaatacaaagccccttttgtgccaaatgagtgtgttattcatgtgttattaaattttggttgtacagattgcaaaccatccattgttaattaggcggatatacagcgatgaggatgtcattcgcatcgccaggaaattgcacccaatcggtgcatttggatttgaatgttccttggatagagttatcgaggaagttaagggtttcaacgatttccgtatccaccaggtaaatgtttctctttccaaaagcagttgaatatccattaacaaacatgttatgcaattgaagaagctaactaacttgtttctttccatagcttttgttccaatatggagttaacgataccaaaggaactctctcagacaaacatgtcatgctctcagcaaaatgtcgggtacgtgatattcttcttcatttcataagtcttctttgtgaaactgattaagtataactaaacctgtgagcgatctaaatctccctttatgtatcagacattagctgagcttctcccttcaatgaagaaatccggccatcgtgttctaatatttagtcaatggacatcgatgctcgatatcttagaatggacacttgatgtcatcggcgttacataccgaagacttgacggcaggtaataaaagaaaaaagagtaatttgtcacatttttgacgattctacaaaaaggaagaagcttaagtcattttccttttgttttcaacagtactcaagttacagatagacaaaccatagtcgacacattcaacaacgataagtcgatattcgcatgtctcttgtcaactcgagcaggtggacaaggtcttaatttaaccggagcggatacagtcattattcacgatatggattttaatccacagattgatcggcaagctgaagatcgttgccatcgtattggtcaaacaaaaccagtcactatcttcaggtttgagctttaaatccttgaatcagtttagataactttcagaacaaaattgtggtttggattggtttatgtgtgctctgttttgtattctcacatatatctgtattaactctggcaatgctggtgcagactggtgacgaaatcgacggttgatgagaacatctacgagatagcgaagcggaaactagttcttgatgcggcggttctagagtccggagttcacgtagatgacaacggagacacgcctgagaaaaccatgggagagattcttgcttctcttctcatgggataacattattgttaccttttttgttttgaggtaaaattagtcaagaaacgaagttaatgtgttattctaaacatgtgtaaccactagctattattagacttaaatttaatagatcacgatagttatattttcttctacgcatgtaaattataacccaaaaatttccttctttagacctaaaagtcacaattgttccaaacactaaaatgtggatcagtgatcaaatgaagtgaaccttcaggatagtttagtcttcgatcatcaaagattgtataaaggagtgacttagctgtatttgtaggtatcaaaattgaaaacctcacgcaatgattaaaggtctcaagtatctttattcgtcagagttgtataagacacaaatctcactagattgttttcccattgtctttgccgaaacctaacaatgaacaactagttctattaggattggttcaagaatgtcacatagtataagtttttcttagctgaaaaattctagataacttggaataaattctagatagtcttttttttttgctacatttgaagataaatatctatgaaaatgttcaaattcatgattatattattgcgattaaataattgaatatgactatacaaaataattcactagtaaatcaaagccatactaagtttggattctttgtggtaactgccattgccaagtcacgttttgaaggtgttctcatggtcaatttacacttaaaattgaacctgaaaactaaggccaaccggaaacttgttgaattgtgtgaagtgagaaaatgataatcgtgtataacttataaagtcacatgataaagagaaagcaaccagctttttgtctgccataacagttctttaaaatatagccacaattatactacttaatttagagtaactaatcccaaatattacttatctaagtaataattagaaaagtattcgatatttattatcaattgcgttttaacttgctatataaatacaaagtttaatttttatataacccactaactttttcattttggtatatgataaaaatactctatcccgtgactattccacttgttgttactttttagttttttttttacatagccattatcattgtggactccacaacatccgcaaactcaattatttacttttctatacgtttatttgtttttttctgatacaaaatttggtgcatgaatgacttctcgaaacggtagatggactccacaacatctgcgtgtcttgtcaccttacgttacggaccacaatttacacctatgaaagtgtcggtaaagcaaataaaatcgagaaactcacaccactcttattcaaatccaaagtgaatactccaaaaataaagtaaatgatatttatccaaaaatatctaacaaacgcgtaaaatgtgaattatcttgaacgttttaatacctctttactctctttatatagtgccattttcctcactagcagcaacacacttgaacactactttcgaactctctctttatctctcttgca

SEQ ID NO: 219 - DNA, 3000 bp, Arabidopsis thaliana
aatgtggtaacatctcagaagctctcagtgtttttcacggaattcaaacaagaaactcgcttacatacacagcgataatcggaggtttagcccttcatggagatgcatccactgctatatcatacttcaacgaaatgattgatgcagggattgccccagacgagatcactttcataggactattatcagcatgttgccatggtggaatgatccaaacaggccgtgattatttctctcagatgaagtctagattcaacctaaaccctcaattgaaacattactctataatggtagatctgctagggagagccgggctattagaagaagcagacaggctcatggaaagtatgccaatggaggcagatgctgcggtttggggagcattattattcggttgcaggatgcacggtaatgttgagctgggagagaaagcggctaagaaacttctcgaacttgatcccagtgatagcgggatctatgtgttgttggatggcatgtatggagaggctaatatgtgggaagatgcaaagagagcgaggaggatgatgaacgagagaggtgtagagaagattcctggttgtagttccattgaggttaatggaattgtctgtgagttcatcgttagggataaatcgagaccggaatctgagaaaatttatgatcgcttacattgtcttggaaggcatatgaggagctcgttgagtgtactattttcggaatatgagattactaataactaatgggactgaatgaaactgctgagttttgtattaaggcatctttggtctaaactagtatagaaatgggtttgagggcaaaaaaaaactcaaatgacatctcctgtgtattaattggccagtttaataaaaacatagtaacattaagagtgtcattttacatttttcaacatgatttatacactgagtttttttgatttaacattaacctaaaactaataaattatttattatttgttaaacagaaacaaatatatacataattaaaaaaaattgtgtgaatatgtcaaaatgatactctttattaaacggaaggaatattaaaaaacccatatttaatgaattaaaatgtgggtcaatatttattgatatcctctcttcttttggtaaggattggtttggtgaacctcaaatacaatgacctccatgtgcgtcccatttcctgatttcgaattctataaatttcttaggaaactagataccttccgagtcctatgtattaattaattgtgaccgtttctccgaagtgtaataaatttgcatacgaaaattgacaacctctttttttggttcaaccaaaaattgacaactaaagatggggacaacataatctcttaaaaacggcaacgtatcagtaccttttagagtttcagaacgcaaggtcatgatgatgacgacttccgtagtgtcagtcacttttcgagtttcagataatttcttgtttgattgctaaaaaatatgaaccaatggcctgaaattgttgcctccctttctcacaacaattctcttatctcaagacaccaactcactataatattttatccactaaagtgttgttatataacaaaatacaaaaaatcaaaacaaaaattgacatctaaattttaagtaaattatgcataatttagaattatattgctaatctttttatcttaatttattaattttatccttaaattattagccgtagagtaactatagcattgagcactacgacgacactgatcacattaaagtattaaacaataaatgaataaaagatgcatgcttttttgtaaaaaaaaatatagtatgaattatttggccaaccaacgtgaatgtgaagataaggttttgtatgctttttacaaagtcaaaaagtgccttgaccatacgttaggtttaaaatcaagagttgaataattcactcacaaattcatcgtgacctttaaaagcctatcaataaatgtgtgttagttacactatttgattatgaacattgaccaggattaatgtttggttctagctagatcattcgcatttcataaatagtacaattttttcattattgttatcaatagtattaattatagcattatttcttgtatacgttacataaacaaaattcttgtataaatatttaactagttgttgaatacaataacaaaaatctaactattcatattatacaaaaataatcactattagtattaatgtatcttattaatatggagtagtaattatttttgtatgttatgaatatatatttagatttttcttaagatgtttttaatagtaattatttttcataagatgtttcttattaatgtatttttaggattttcacacatcttaaaaaacatattaaaagttgattagaaatatattattcttcttgaagtttacacatcaataataactagtaataaatattgcatagaaattttaaaaatgactatcttttcgaatcaaaaaaatttcctacaaaatacaataataaacaaagagagtagtactgttcatctaaatactgtataatggatgttttaccaattttaacaattacgtacaaaagtttcacacctttataaaaaaaatttgatcaattatccttttatcttctttatttttgccagctaatatacactgcaataatccaaacttaacaaacatttaacattacttcagattcatcattcaataatttcacaaacccataattttaccaaattactacactaatcccccattggcaccaattctataattagaaaatttatttctttatttatttatttatttatttctatttattaaagaaataaattatagaaattggaatgcccaccaccaccagagaccacacttgcacaaattccatctataaacacaaaagcctttagtatcattctcgaaaaccaccaaaaacctctttataacccaacaaacaaagtctctacttcttcttcaatcactgaaacacaacaccaaaaaagaaaaaagt

SEQ ID NO: 220 - DNA, 3000 bp, Arabidopsis thaliana
ttcttcttcattccgcgccgccgtcccgcgttttttctttatttgactcttctcttcgaaacgaccgtggttttggtgtttattgaaacgacatcgttttgttcttcttcttcctcagttttgattctcaaaatccacaaccctaaatccacgcttcttctctgctcttcttactcaattcttctgcctctttcttggtccttgtccactaatcgtttgttcgtctcacggcacgaattcaaatttgtaagttgagctcgtcgaattagtgaaacccgagaatagtagaattcagcagagagatgaagattgcaattgaaggttgtatgcatggagacctagacaatgtgtataaaacaattcaacattacgaacagattcacaacactaaagtcgatctcctcctctgctgcggcgattttcaggtaatcgtttgtttttttttaccttgaaaataaaaatccattcgattctgcttcctaagtctgaaaagattcgttctttgtggaaaacattaggctgttagaaatgagaaagacatggatagccttaacgtacctagaaaatacagagagatgaaatctttctggaagtactactccggccaagaagttgctccgattcccacaattttcattggtgggaatcatgaggcttctaactacttatgggaattgtaagttatctagtatttgagtttaggattccgaggcttaaaaaatgtgttcttgatggttgctggttgttgtgctataggtattatgggggttgggctgccaccaatatttactttttgggttttgctggagttgtcaagtttggtaatgtgcgaattggtggcctttctggtatatacaatgagcgtcattaccgttcaggtttgtttcttcttcatctctctgacaaagtaccaatttttcagcttttgaaatgggagaaagttggatttctgagttagtgtctatagtggaaatgtatagattagggaattcgtttgatttgtttggtgtcaataaagtgagaatcagtcatttgtgtgagtaggacactttgagcggccaccatataacgagagcaccatcagatcggtctatcatgttcgtgactatgatgtccagaagttgatgcaacttgaagagccgcttgatatatttctatcacatgattggcctgttggaatcactgattatggagactcagaatcacttatgcggcaaaaaccatactttcgtcaagaggtaaatctgtgggaacatgattctacttcttcattttggttttgagaggttttcaattgatttgaccaaaatttattacagatcgaggaaaaaactcttggaagtaaaccagcggctctactgctagaaaaactgaagcctcaatattggttttcagctcatttacattgcaaatttgctgctgctgttcaacacgggaatgatgggtcagtgacaaaatttcttgccctcgataaatgccttccagggaaaaagtttttacaggttctctttctttcctgtccacaacattatgctttgttcttttgaaacaaaaaggatatcttttaatttctttggatgttcattagattattgaaatcgaatcagagcctggaccctttgaggtcctatacgatgaagagtggctagcaatcacacgaaagttcaattctattttcccgctaacaaggagatacacaaacgtcaggtataccatcccgaacaagctacctactaagaaatgtttatatatcttccatttatctttctacctaccgtcccacttacgtattgttttactacaatagcactgctggaactatacaagagagccgtgagtgggtgaggaagaagctagaagaaaggcaatttaaaccttttgagtttgcgagaacagtacctgcatataacccatcacaacgtgtatttgattccattcctggtatgttaatagtgtactggatatagaggattataaaaagttgatggatcgattaaaagtgttttattcatatggcattttgtagagatcccgcagaatccccagacgctgtctttgttagagctccttggtctcccatatctccttgattcatcaccagtaacaggggaaagaaccgatatccctgcttcactggctccatcaggtatgacgatagttttctttgtagatgaggacttggtttgggattatcagatacatattctgtgaagttgttcatttactctttctatctgcctattgtcatgaaactgcatcaagcaccaatgacagagatgtttagtgcagtgtcaagaatcaaacatgtcttgttgtgtattgcagatcttccgacatatgatagcgaagaaatcccaattgatgacattgatgaaatagaagagatggaggaagcaaaagcagatgatcatacaagagacgatgcatgaatatctccattccagtggtcagaatatattttatcttgctaatatctgactgcttcatcgtcaagctggaaaacaaccacattagttgggattctgtgattagaaaaccaagttttcttgttcattttttagaatcagcataagttttatttgtgatattaaagaaaagtgaatcataaaaatgtcttggagaaataaaaagttagatattaatgtttcatccagtattcaagaaagttgatcaccttttcttccacaagttctctggcatgcattggcttgggaagttactcgccgacaaaacccatagataagtatgtcggattcacttaaaaccatggatgatgctgggaatgttggattcaactaaacacgaccatcaatgattcttcattgaatgcgttgactcaacttcatcacctcaactaattttctatctctgacactaacatcaaatgcaaattatgaagtgaacagttgcagtttattacaacaaccttcaagattcctctcattctcctttctattttcattgtcactttattcgagtcaaaacacagagacaataaaa

SEQ ID NO: 221 - DNA, 3000 bp, Arabidopsis thaliana
gacccgttaatcttacaatcagcttcatcagattcaaactcaagctttggagaaaagcctgcatttttagctgtcacatagtaaactctcaacaaagtgttgaaagacatcgaattcgacattcttccacaacatttgacataaccactagcaaactcaacccaactcaatccttctttatcaggcacgaagaacaaatctactaaagatgatcctaaatgctccaacaatttgggaaacaagtctgaaactttttgctctccttcagtagtaattgtatcgtagctcaaaccaaaactttgctgaaacaaagatccaatttttataaccctaagttagattatacacgattctattgaaaacccagattaacggaaatcgaattataccttcaaggattgaaaaggaacagtattggtttgagaatcgacgagtttggagaaggatcgtttaagcagaggaagagctccggttgaagcagcaaggctttcgatttctcgtttctccgatgattctttgtcgtctgtagaagatgaagcacccatagtggtgaagatgatcggagaagatgcaaaaatccgaaattagagggaatgatcagagaaattggagtccatgattagaaattttgtttttgatctttaagaaaataaagagacgtttttgaacagttccatagatgatcttttcacgattcgccacgtaattggagtcaattgtggattgatccggttccggttcgagaaaatattaaaccggactgattagcaaaatgtatttaagccgaataccccaactaatattttcaccaaaagaaaaagtttcaaagctcccactaaatttgtctatttcaaaatattttctagctatttggagtttacattgacattttaactccaaaaaatatttttacaattttggcaaaaaaaaaatgtaatttaaaaaatatgcaattctttgagtttgagagaaaatgtgtttttgcggaaaatagaaaattatattatatatttaggttccatacactgtctaattaatcattgtcttatttgagtttggtcatatttggatacggtgctattgagtttggtcatatttggatacggtgctattgagtttgtatcattagttttgttcatatttggacttcacccatttagatctgaacagctcaattaacatctttagatagatgtgctcaacagaaaaattgagattatgcaatttagtgtttagggtttaggggttaggggttagagaaaaattatttccaattcaaatatcatttgcggggaaatctcagactattttcatgcaaaatatatagaggctaatttgaagagggtgcttgtaacaagacccagagaaggattttagcaactcatgggcaattaatgttgtccgtatgtacaaataaaaacccaatggaccgacttcaaggtcgcagcatgccagcatccaaactcgttcaggttatctagctttacatttgaagcaaagacgatcacttgcgttacgattagttagaatatggttttggtaccataaaaacaagatttatatatagaccataagggtttttactttttttttcttttaagcttcgacgccaatatatacatatgtgtagagaccaaaatttggtcgatgaatatacatcaacgacgacaagatataatatatgataatcttcaatttttgaatttttctagtctttgttaacgtcatgcatggatttttataggaaaataacatctatattgacaaaaattattttaagaaacaggaattcatagaaaactcttctttttaaaacatctgactttattatatcctaaagggacaagtagaaaactctttatttgttatatgtcactattctgttacaaatttttattgtttcaaataaaaattaattgcagaaaaaattcctatggaccaacaacgatggttagtcttagtcagcatgagttctggctattgatcagtgatcaccaccaatcaacgtgtcgccattagtcattaatctgttatgaaagtaaacgtatagaattaatctttatcatcacaacatcattctatatagcaaacctggtgcgggtagaacccgatctttatccgaaatatatatctttaccaaaaaatcgaactgaaaaattcgacatcattcttccatttccagattactaaaattcgaacaaaacaaaccgaaccagtcaaagaaacaaagcttaattattaagaaaacccactatactattttgttatttgtttgtttgttaaagactatactatctatatgttccggtcaatacactaatctctcacgatggatcggtccgtggacttttgttgaatagtgatgtccgtggacttttgttgaatagtgattagtgaatgttcatgttttggatattttaacacttttgtgagacggtcagtgaacttttgttgaatagtggatgttcatgttttggatattttaacactttttcttttcctaaagtattttaacacttattcgattaaccagtccaaagtcggtgcattgtagatgaaaatatcatgcactaatacgagtttccttaataaagaattagagttgaatcaaagtttaacgcctgctaaaacaatattctataatcacattcattataaatgattacacactattaattaggaattagtttgatagaaacgaacaaaagagaaaaaacaaacccaacatgatctgcaatcgtcaacgcgcgaagccagctcatgaccaatcacataacgcggttttcagttttgaattggattacaacgtcgtcgttttgtcaaattacctcaacactctagcccctttcgctgacttcaacatcaccatttgacttctcaatccctctataagttactcacgttctcgtatcactttccatgcatctaaaacaaactctatctactaactcgaaacacacttgcggtcttatctaaaacacaaaccaacaaaaagaaaaa

SEQ ID NO: 222 - DNA, 3000 bp, Arabidopsis thaliana
aaatggatttatatttgtttctgattctataattcaaagtctcattcttttttgcatgattcaaattcaataaaatcaaatgatctatgaagaaacaaagaatttgctttaatggttactactactagtttgtgttgtctcactctgcatcaactgatcgaatatcttcaatcaatttcaaaacttgagctatatgaggtctttcttgttgcttcagagcaacacaagccaatcctatttgcaacatctcaaccatctcctcctcgaaaccacctgattgactcaatatctccatatcaaacacttctccagtccactctttagccaccacagatcttatccagctagctaagtccatgttctcacctcctgttggtactaattctgcttgactcactggtgatttccctgtcaagagctccagtaataccacaccgaagctgtatacatccgaaaactgtgtgcttcttcttgtgtctgttatttcaggtgcatggtagccagaagtaaggcaagtggtttgaggaagtgatctcatgattgtcgtcaagccaacatcgcctatgcagccatagcattgtgagtctaagaagatgtttgaggatttgatgtttccatgtatgaacttcccttcgtggattttagctagccctctcgctgcaccggttgctattcgcagtctagcatcccaatctaacggtactcgatgataccttcctctgtttcctgcaaagaaaatggaaccttgtagtttcgatttatcatcagaatgagagcaatgaaaataactaaccgtgcagtatttcgaagaggcttccatgattgtaatagctataaaccgcgagcttatcgtctttggagtagtagtaagcctttagctcagctacattttcatgtctgatcataccaatgatctccatttgttgctcaaactctcgtcttccaacgacaacttccttcaatcgttttacaacgaccgtgctcatgtcctccattgttaccttataggttgtaccaaaagcacccttccccaaaacttctgcagatgagcttagcaaatcatctaaatcaaataagtggtttcttccaccaaagaagatgatcttcccgccttcttcagtgttatcatctctagatgtccagtttcctggaggagaagacgagtctctctttcgcaacttcccggagattctagtcttcccgaaacaagtgatcattatgaatgataatccggaaacacacaaaacgcaagctgcagacagaatcagcaagaaagcaagttggcttaacccgaaaggagtcttgcgttgtttcttcctctcggtaaggttgttgccagaaaaagctgaactttggaatctttgaagagactttggtattgtaccgatgagcttgttgttggacaagttgatctgactcagttttggaagatgaagatttggaatttcccctgagaatgaattgtttgcaagattcaagacttgaaggctagtcaatcctgaaagagaggttgggatgcttccgttgaatccattgttagacagatcaagaaccttaagattcttcaactccgagaagatagctagtagtggacctgagaggtggttatgttgtaggtagagatgagtcaagctcttgagatttgtgaaatcagaagggaagtctccggtgaaatggttctttctaaggcttagaaacttgagagaagagagacgactgatggtgaaaggaggaatcaaaccgttgaatccaaccgcaggcaatctaacggatacaattcgatctccgttttcgttgcaggtaacaccggtccagctatgacaaacgtctgagctctggttccaatggagacgagaagaattgaaactagacaagaaatgaagcaaagctttcttgtcgtcttcaagagtctgagaggaaatcagaacaaaacagagaatcaaagagaagaagaacaagaagatttgcattgtgaagaaactagtttttgtctctaactgtaaaacagagaaattttctttagcagaagaatttgtttctgattaaaaaaatagataaaagagtgattagaaagatacgccggcaggttttagccggcaaaaaagtcttctcttatataagctgagaaaactaaaaaaaccttggagccattaaaaccattgagaccgtttctctgagttttgatcgttgggtgtatttaattcttgcttcaagaaaattcataccaaacggctaatttctcttaactctattcctaaagcctgtaacgtaagcgcggtaaaattcagaggcttggcatacaattatcaacaaacaaaaagagctgaaatgttctcttttttttttttttttttttttttttttgatcaccaagagctgaaatgttctgttttgtggtattttaagataatgtcttcttcatttgtgcctaccaaaaaacaaaaagtcttcttcatttgtatcatatatgcgtacgtttgttaatcaatgtattatttaatagaaacatgattgtcttaagtaattttagaaattcattttattttgtatcattgtttgtctctcagattcatgtaattggttaggactttttttttctttgattgttggctaacaaatggatagagctttagagttctccaaagtctaaaattgattcaaaaaaaaagctcagaaagaagatactatatgaataacagaattacatgccctaaatgatttaatgtaacataaaacattatacattattcaaaaaatgtatgataaatataaactcttttttgggtataaaatcaataaataatatttatattggcataaaacgagaaacacgtgtgatgggatggttctagtacccaatcaaattggataaaaacaaagaaatatgatttggctgggtctactataataactgctgcttggtgaccaaaataagacgaaacggcttcttcatcaaatcattcatcctcatcctcagactttggttcttgtttctcgaag

SEQ ID NO: 223 - DNA, 3000 bp, Arabidopsis thaliana
tgaagacggatgtggtgatactccctgcaaatttaacaatacttttgaaatttttacaaatctatcgacttattaaatcaataaactcaatctaaatccaattcccattaacatttcttctaaatatgattatggatatcattatagaattacctgtcataaatgtggtagaagcattaccaaccttcgaaaagcgtacaggtggaagatatgattaaaccatcatgacaagcgtctggatttttagatctaggagttcttgaagacggatgtggtgatactccctgcaaatttaacaatacttttgaaatttttacaaatctatcgacttattaaatcaataaacttaatctaaatccaattcccattaacatctcttctaaatatgattatggatatcattatagaattacctgtcataaatgtggtagaagcattaccaaccttcgaaaagcgtacaggtggaagatatgattaaaccatcatgacaagcgtctggatttttagatctaggagttcttgaagacggatgtggtgatactccctacaaatttaacaagacttttgaaatttttacaaatctatcgacttattaaatcaatcaactcaatctaaatccaattcccattaagacctctaaatatgattgtagataccattgtagaattacctgtcataaatgtggtagaagcattaccgaacctttgaaaatgtaaaggtggaagatatgactaaaccatcatgacaagcgtctggatttttggaatctaggattttttgaacatatagtgtggtgattttttggggagaagagatcattgttgatgtatgttgcctgagttatggccgcgacgaaaaaatagactgaaatgtgtgaaaagatggtataaatatctttacctaggtttctaggttttgattactgggcatgtgaaatgggttttaataaatgggcttgggcttgtaaaattgtggaattaagctattgtaatcacgcatatgagttatctaattggataacttattagattgtaataatgagggaaaaaaaaagattattataatgagaggtccacatttaaaatgatgtgacactcttagcaaataaatataacatggcaaaatttagaagtgttgtcaaaaaacgataagcgtaaaatggaaattgtgactgaaccaccataagaagcgtctggatttttggagtccgagagatttagaaagtggagtgtggttgttttttttagagggggaatgttgttgtttatgccattagagtcatggtggcgtcgaagaacaataagtatatgtgggaatcagagatgtgtgtaagagaaacaaaaatttatttggttgggttttgaattttcaagaaaatgttaaattatttcatcgagtttctttttttttctctatgttaggaaatggtatggtcaaaatctattgatgatggtgatgcctaacattaacaaaaccaatagaagggagacaagagacataagacatcttcttgaaattcatcaacattacaaacttactaaaactcctcctcccaatcccaaatgaatatgtacttcttaaagccacgtgtctttctctttttcattaatatttatttatttttttaaaatgtgaaattatttctttggtttaatatctctggatcattcttctacaatgatcacaagtatttagatcatgtgtaaatagtcccatcatgaagttttaattaccaatcggtattgcacatcaccgattggtactgatccacctgcacttttgtcgatcttttgggacaacgaaaaagaaactaatttaatatattttgttatccgctcgaagatattaattataagctttaatttggaacttctttatatcaattatatatatatataacttctttgttaatagaaaatgggaacgatccaaaacttaagacatttgatctccacaaggccgtcgacgtacagagaagaagaatggccaaaaataagtaaataaaagagaagaaaccgaggggaagatgattttgcattgccacgacccacgagcatccatcggccatcgcctttttggattcacatggcaaagacaaacttcgatcttccttttttctcgtgaagttattatctctctaatttctagtctggtcgaacctatatttcatcatatatatcattatttaattcatatgctgatgcatgggacattatcatgttaagtcattacaaaaaaataaaaataaaaataacttacgttggactctcagtttaccttctcctatggatttcacttccttgtataagaatatacatcttactcaaatcatgatttatatgcaattttcttttgtgagattttttttacatataaaccagaaatgttgaaagaagaatatccaaacacaacaaaataatagaagaaatctcacgtagaacatggaaatggaaaaagaagtgaactcgtgaaccgatatatttaccaaaagtgcacacatagacaagtctttctcattaaagcccaatttcacactttcacattttcgtgacgtcttttgaagttttgaatacgaattaatgttcatgtacgctataaagacctaaaaggttgtcatatttctccactttcatcttctcttcacaactatcctaaaccttttttccttttcttcttcttcactctctttcttcccggcgtcactatggcggctgccgccgggtaaaggcagcgaactcgaccacatcaagaatgaatccgttgatctggtatatatatttacgtcttcttagttttctattatctatatgttttaaaaaatctttggccctactaattttaaattttctgttacataaaagatacatatatgtatagtacgtaactagtaactactttgatctaatcagttaatatatttgtcccatgcgatttactcatgtttccattagaaatgattagtcaaaattatataaatgatgggtctaggtacgaataccc

SEQ ID NO: 224 - DNA, 3000 bp, Arabidopsis thaliana
aggctaaaagcaagtgatagaaccaaatcttgattggaatctacaatgtatctagagaatccttatgtcgccatggcaagcaagaaagagatcaaggaaaaataagatcgtgactaaacattggccaatgttctgtactttttggtgaatattatagaatatgtgttcacctggaaatgctggtgtcacaagctttcctttttctcttgagaggtttaaggccaaggttcagagctaaatcctcaacaggaaccttgatcacatcgtttctaacaccgatatcagtagcatacctactcatacaatacatcccagcagtgacagttgctacaccaacaggatttggaatcaacaatgtgagaggtgacgagagtagtgcagctagaggagcacctatgatagaactggcttgaccacttctcccaaccccgttcttatccagaatgagcaatcctgtcttgcagtagagagcaaaatcttcgcagttattctggaagacattgtagttaccaaatccgttttggagaaggtgcattgctctatggatgactgtttgaagcgggtcagatggagcagttgtgcacgtgccaccgcggaatctggtgaggaaaatcgatgagctgactccataatcaaaacggtagagagaacctttcttgagaaagcagtctaggcaagaaagtactactccactctttggtcgtttatatccacagtcaggatatgtaggacaaggagcttctgaagaatcattaacctctgaaactgaagaagacgaagaagaagaagaagaagcgagtgtaggagatatcaagctgtgctcaggtttgaaatgaaccactttgcaaccaccaacaaatacgcctacaaatgtggaaaatttagaagaaaacaaaatgctttcttcagttgaaatgtcaacaaaagcaatcaaaatctatttgctaccaccattgactatagaaggacaagtcatcatcagtacgattgaatccagagaaaacaaaagatgagactttttgaagatccgtttcaataaagtcaaaaactttggcatgagggaaaaagacctaataacaaaacagagtttttgacacaataacccaataagaaaccaaatgacggtttgtttcttcatctctgcaacggaaagaggtaacataaaccctaaaatttacacaaagaagatccaaattgaggaaaaactatggatgattcatgccaaaagctcattgatgatgaaatcaaaaggaagaaatcgaaggtaccgtggtgagaataagcgaagacggctcgataagtgtagatgtgatcaccaggtttaagctcgtctctctcgactttgttcgtgagtacacccattgcttcgtcttcctcaaaataaaagctttccctttggcttgtggaaattgcagtgtacaagtagattcttacgtcagcggcagagatatgattgggcgatcaaaccggagactgttgaaccaatgccgttacagaatcttttgacggcgttaactgttagatgacgacaatcgctgtggagggtaatatggtcaatatacgaaaaggcttttgtgaacacgacgccgtttttaaagtgtccctggaatcttattcttcctttcttggtgtattggactcatattgggcttaaagaaaacgctctacggcctaaatatcgaaaagcgtattatttatctatcaaccaattgttattttgctcattgccaactaatgaacaatgcttagaattaatcaaattttctaatctgaacgaaggaagatataagtaggagttttatacaatcgataattgtatacttaattattattataagctatattggttaatgagtttctttggagtgagtatataataagaaaaatatatatagagccgagcgtagtggaggtagatcaggcaataatggaagaaacttcgaggaacttcgctttttgttgtaaccacaaaagcgaatataacaattaatacggtttgagtaggcttgcagattttcagacagcactcctactgacagatgtttgaaaattaaaatatttattgcgattattataacaacactgtagtaaggaacttttgggttatttcattggtttattaaagtctttaatcgttgactttttaatttcattattatctgtaaactcgtattttaagtgattttaataataataatttgaaagtaaaatggaatatcccccgatatcaagcgagccgtacgggaaagggaaagtcaaacatgtaataacagttttaaatgaagggtactacagtcttttcaaggggttaataacgttccgttttctttatggacagccaatcagatgggaccacgtatatcactattaccaaaccttcgcttttctggaaagtggaaagcaaaaccacagagagaagagaagaagaacaaagcaaaatatattcaaaatttaagcaataaaggcaaaaattaaaagacaacgagtttcaaacacgaaaccacgacttgtccaaatcaagatttgtcctttttcctttttagtggtagaacgcgaatcaaatttgggaataaaattttacttcttactttttcaaaaattcttgggtcttcttcagctttgtctccaagcaaacttttagtcaaatcatttttttctttcttgatggactttctttcatgtttgatatttcaatgacgaaagctctaactggtttttcttggaatttaggtaagaatttatactctgtttctctctctgtttaactcagttcttgttttgggtttctgggtttgtattttttttagatctttgattatttattatgttctatgttgtaaaagatatcaaaccgtcaataaaaactgtaactttatttgttgtttaaaaattgatatttcattgtttgattgaaatttttctacaggaatttgataaacggtttctcacatacacaagaagaaaataaccgttttgagttaaagtaaagcttttgaacca

SEQ ID NO: 225 - DNA, 3000 bp, Arabidopsis thaliana
ttcggtgttttaggtttgtgtgtatgatatgaagtttaacttggaatatatatataaacggatgggattacgatgttcttatgaagtcggtcgatgtaaatggattaaattttataatggtttgtgtacgtgtgagggttttccacgagtgagagtgaaagcgtgggttatacgtgtcttctgcttgatttttgattttttcgttacatgacaacaatattttatttcaaaaatatatcattcatgaaaatagatattttgtttgcagttatagctaaactagataattaaatacctttttagatagtcacacgataaatttaataccaaaaaaatggaaagtattatacaaaactaaaagagggaaaagtattcgcgtaaggaataagatgcgcaagggattaatggaccgaccatgtccccccatatgcacgtcggtggaatgtagtagtactcccatgcattgcggtacactatatggacaatgcacttatgacccgtattggtatgggtttctgatggatattaaggtcaaacttaaatgggccacaggccataagcccattcaaatttgtaactggactatgatcactgtgaagtcgtgaatcttcttctcttaaaaacaaaactttgacatgatcactgtgaagtcgtgcactgtaggcatgtcacgtgttgatggatgattagtggaaagggattggaagaagcgtgtccaattagtcgacagctgcggaatggaaaaactgagtcagcatttatgttaagaagtcaaacctacgcctcgcatggtttgttagttaatttgacttattgaccagtcaaagcatgctttgacattttagtgatacacaaattttataatataaatccgcaaacactagattatattcacacttctctttaattagtgtttggttccacgattttcaacggccgattgtactttttggttgcaaaattttacaaaacggtaccttttgttttgtacattttaaaaatcaacttattatttattggcatctatagttagggaaaacgtttcaattgaacatgtacgtgtgcataaatcaaaattttatttaaaatatacagattcgcttaaggagtataataacactccacgaacgaaattgttatgtatatattacatatataatttgtaatcagtgaattaagacattcaaataattgaaattaattaaacttttaccaagaaaataaatttgataaataataattgaaattttggaatgatatcaaaactgccgaaagcacatatgtcggtgttggtagttggcgggccaattagtatacgaatacgaactccttgttcggtgtttcttttacaaattattttcttttattcataatctatttctaattcattagatgtttcttacctgcatttcatgagaaacacatccaaaaaaaaaaactatttacaaacaaaaagttcttcttagacaaaataatatattcacaaagctacaatgtttccaaacttgataagagaatattagtttaggactgtctttaattattgtttacacaagggattcgtaggatcccaaaaaacaatgggttcgttggttttgtttgaaagtgtagatgtaacgactccaaatagccaaaagttgatatcttcagtctatattattgagatcttatgtcccccctgtaattaatttttccagcaatgcgtgcttaaagaatattgtttgagactttagttattgtaatacgacattagtataagtagagccaaaatcagattttaatatctttagtcttaagacatgaaacaagattaagaaaataccttgttttcaaagaaaacggttataaaaaggaggatttgagtttttgacattcagacgataaaaattatgaactaggtctagtcacgtggtcgacgcgtgagagtttccggcgtgaactgcaagtaaaatcacgtagagcatgtgattgacttgaccaaagagtccaaacccaccaactacaaaaaaaaatcaagatataaataactaactctcactagtcactaatataatttttcattacaattcatatatgatctactaacaattgttgtggttatacaaacaaaaaatttatttttcgtaagacggaaattttgaaatcaaattcctcaacactcaaatgaatattcagtagtagtttatcaatgactagattagatatttcttaacgccagtcaaattttggaattatgtggaggacgtacgtttatacatgtgcagactacaacataccaaatgttttattaaaccaaattacaatgttgcaaattggtctattcttttgaataatctgatacattttatctcataactttcttcctttttatttgaattcaatcaaataatattctccacatccccaaccttctttttttttttgcatgactaagtagtttaaggtcaacatttttcataagaagttgcttagaaatagccttgggttcaaataaaatacacatgattttcccgtttccaccaataaatcccaatggattttaatactgaaacggaaatcaatgcgaaactattggagtaagaccaatttattcatcttaatctaccaaattcggatacgatatgtttaatacaagggagattgatgctagcaaaacacaaccatcttaattttttttttttttttttaattagaaattcccttcccaaatggtaattcaatcgtaacaaaagtacgttttgaaatattgttttggatggagattttttccttggttcgcttgttacttttcacttgtttcatcaaatcctaactccttttattttggaccccacatcaactttatttggtctcctcaaggtttctgtttcaactcctatataaaagcaaataactcatacgttaattagtacacaccacaaaaacttgtcataagatcaatatcgatacccccaaaaaaaaaaaaaaacagctacaaagaagtgagaattgacacagcaa

SEQ ID NO: 226 - DNA, 3000 bp, Arabidopsis thaliana
gacgatctagaagtttttctggtgaaaaccgccctgaactcgtcatgtgtcgatagattgcatctcctgtgctcgcttttccgctctgcaaatgcataatattgtaagcaagaaaatgacaccaaaaatagaaaaccaaaacttcaaaatcatcttaagtgtggttacctttggaagagttgccatgtaagaatcaggaatatccatttcaccgagtatgctgctattgatggccatagcagctttatggatttgattagtgctctctcgcttgctcttaagttgtttccttgccttctctgataaaccttgtaatggaaccagaggaatcggtaaccaccatttctcttctttcctctgcacaatcactttcctgaatgatccagttgcggaacgcgttgacttcatcgacaagcttccttcttctgcataccaaaactctgtcttttgaaaactatccaatgcctcctgcagaaaacaaagagaatgacttttatgaggaatattaaccgagtcaatcttattgatgatagcttcttgttctggtgtagtaactaccataagcatggaatctagttttctgagtgcaggcagattgatgtagatatctgctcttggtctactctccatgacctgacaaaaaaaccgcaacagctatttttaaactattgatgtttatttcagtttttggacttatatctataagcaaatcttgtttacctcaacagtggctccattgcttagattctgtgactttgggataaactcgaaaatatagtcacacacagagagaaggcaattcatttctctcttccacgtcgtcttctgctctatctccaatggttctaatcttagattctgtccaaaaacagtagctgcaaatctcaaaatcaaaagacattaactacagtttctctagatggcttagtttgaaagtcacaaaactgtgaggcgtattagtgtttagttaccataaagattggttatagcgtttgagattgtcactgcggtgcaaacgcctttgccgcttcctgacatatcttccccaagcagaagcttcgagaatctttccttcatcgtctccagctctgctacgaaaccgataacagtttcatgattataatgacaaagaggaaatacagacacagagaaagagagagagacggagaaacacaaaacctggctctgaaatttcttggaccgcaaggtgctcatcagtctcaatctgattatgtttcaagtcgaagacagttggaaaatttgagctcgcagagttgttggattcggttaagacaggccaatcactaggagaagcctcagtgcagaaactgctggtttcatctatttggtctgaaaagcctcctccagaggtttcagaacatgttcgatgataagcaaaagaatctgtgctcattgttgagtaaaccggagtttcagatgctgaatgatcatttggatcgatgggaccaggtgactgatgatagcccacatcgtcgttttcttcgtgatttggcaaattctccatcttctcaatgttctgtttttgaaaattcctctgcttttgttgatctcttgttttaataaaagaaataaagcttagaactttcgttgtgatgtatcaggaaaactttagaatatgaatctaaatccgacaattagaatcgggaattatttttgattcttggatagtgaaattttgaggaccagatagcagtaaagtagaagaattgttttgtttttttttggccaaaagcagagaccgttaggcgtgccaaaatcaaaaagcaaaacaaaacataaagaaacgaaaagaaagaaatgaagtaatcacaacattatttatcgaaactttcacgaagatttattttattactataacaaacatttcgcttatgtcgatcaagatacatgaaagtctgaaacttgaaattttgaaaaacgatattaaggaagaagaaaaaagcaacggtctttattttatttacctttaaggctttaaagcttctgcaaatttgtctttgaatttgaaacgcttgaatcttttataacgtttataaaacactctcttttccgcattaagctttctacacaatttatcggtgcccggaaaaaacttgaacaatgtggaccgtccgatggggaaggatgactcatcctacggttgagattgtgaaatgttttttcaaacatttcaactaaaacaactaattgaagatacgaaatcataaaccccaaaggtacctagcgtgttacgcgagaaacacatagctacagagaatatctgtttccaaatgtacatatgctttaagattaagtaggaggaaaatccatcgtgacagtgagacccaatcgatcgagaaagcatccatgatttggagaaaattaatactgattcaaattgaaacatagactagaaacgaaaaataacagctttcaggagttggtaacaatttaattaaccactgagtgataatcgaacaagacgaaaacccgtccggagtggttactataacttgcatatagtaaccattggttttaaacaagcaaattaaacgaaaagaaaaataaatactgattcaaatagaaacattagactagaaacgaattaaaataacagctgactgagattctgttattatcgtctcttctcatgggccatttagaaatttacttagttcggatttattttaaggccttaaagccattaatgggccttgaggttgtaggatttgtttattgctttttgtttcatctcaagaattaaattacatcacaccaatattatttgtatatttcttcatttattaatactaattattattattttatttataacacgtgagagaaataaaaatcgaaccgagtccacgtattcttccataaaccggagctggtagttgatacaattgatttaccttgccaggtgggaggaaaccacattttctcacacctaatcatcatcatccaaccggcgatttcttccgactagccgaatccgcc

SEQ ID NO: 227 - DNA, 3000 bp, Arabidopsis thaliana
ctaattattaaccttaaaagacttctcggcttttgtgagacatgacaatatcaatgtacaggtaacattgagccgaaacttgctattgttcttgtctcacttcttaatataactttagcccaaaatatttgtttatgcttgatgataattcttttttttttaagtaggcaaagaaaacgttaacgactaattacttttacaacccatgaaaaagggattttttttttttaaaagctaaaaagagagggataacttttatatttttaatttatacacaagtaaaatgcatttctaatttttttttgttccataagttaatttgccattccatgacttttcccttttagttaactaatttactaacaaaaagaaggaaaaagagactttcgaacagtattattctttagttcaaattcatatataatgatcttattttattctcccccccccccccccccacattatgacacaatgtcggacacatagtgttgacttgtctacatgtcttcttgtatcaaagtttaattaataataacacatataagaaaaataagggaggaaaaagcgtttcaacgaccaaagagattccaacggccgttttgctcatcccattcctatgcatgtgccttcccatttgctttgcttttttgtagtttgtgtcgccggttctttgcatgccacagaacttaatagttttatcataaactaagaatttttgttgaatactctgcacgtaattatatttcatgttccgacattagcccaaattacggtaaaacatacatgcaggttcatcttaagataatgtattgactatgttaatattagaatatacagaatataatatgcgtttaaactcatagatccaaacctccatactagtaatattaatgaaattggtattttatcaatgctgaaattagtatctatgctacgttacattgtctaacaacgctgatacttcaaaattgaataccaagtaaactaaaataaaaacataaataaatgaaaaaaaaaaacagaaacctcagattggatgtcttggagtttggtgaccgactgtctactttagactcataattgatctaaaattgtgtatataagttcaagaagagacgtataaaatcataaattaatatcgaattgtttagcaaatatggtcaccaaaatttaaaatgataagagttaggttttgatataaccgatatgtatgtttcattcatggggataatgtcggctaatatgtcagatgacatgttcattgatccatcctgtctccggtcaatttttctcccatacttatttttatattttctatctttaatatttagaggaattcaaatgaattgaaggtatatccattcatcaatttgttgttcaaatgttgtaacaaagaaacaaatgtgttgttcaaaatgtggattatcaattttgagttcactcaaattcaattaactgttatttttcaacaaaacacatttctgtattgatcaatcgaatatgttattgtccaaagtgcttataactagtataaaatataatataatgaatcttgcaaacatgaaaatatgcatcacttcaaaattcaacaattttgaactgaaaatcgactatacttttgaatgttaatttcgtaaaaaagtgggtaggtactaggtattggtagagaaagagttgagagaataataattgaaagaatatgggctatgaaaagagtctttttagttaaatcggacggctaatgggagccgtcaaggttgaccatttccactacgtgccgacatatcagccttacacatgccccatcctcctcacctttcccacttccttgtgactcttttccacgcgcctcttctagcatttgcttcttctttttatttgcctcttcatcagaaaaaatattataaatctaaacagttaaaatatctatctacgaaagacaaatcttgaaatgttttagtactgcattttgttggtcacaattaacaataataattgtgatgcatgttttgttagccagacacctaattagttctctctaacttcaaacagagaaagaagtattgtatttgtcaacgctgatacaaaactgacactttcaagtttaagtttgtcatatttcttttaccaaacttgaaactactgcatttttttttataacttgttcatttgaacaaataatatttttatttttttttgccaaacttgtcaatataatatctaagatcggactcctcctattgtcaatcttaatatatcacaacaataattgatctaacttatattgtatacttaattcattgaaataagaaatcaatattaaatatacgcgagtcttatgactaaccaaacacggtgatttaggcaataagtgctcaatctttcaattattttaagaattgaacatcaacatcatctactactttcctatcaccaaatttcaaactacccgattttaatagtaataactaggttaggcaagaatgttgacaataaaaaaaatgtataacacaatttttaagttttttttttttttaatcgtatcataaaaattcctagtttgaaaatgactagactgatataaacgtaattttaattttaaaataatttgcttgtacaacttaagatccaatttaatggagatagacatgcatgtcaaatttcattattagtagacaagagctttattcatcttggcaataattttggttttaaagaactcgaccgtccccattgatgacatgcccaccttacgcgatttgtaggatgagaagattactttaaattcccccatttgtcaaccgtatggaaaccgtagaatttaaaactaaatttcgaaaaaagtctttgaatttaaaatatttattttatccttccttctcttcccaattcccatacactatatatataagagctcgtcactcttctttcagattcaaaacctcctgatttcattctttactactaataatcattttttgaaaaaaataaaaaagggac

SEQ ID NO: 228 - DNA, 3000 bp, Arabidopsis thaliana
agtgagcttcccctgaaggataaaagattcacaaaaagcaaatttgcagtgagcttcccctgctgtggtttactgtacaataaatctcacagtcccctttccttacatgcttgaaaatggaaaagaagaagaaccagcaggtcttggtactgacctcatcgacgatgatacgattccacttaatagagtgtaaaggagacattgtttcgtccactccttcatccttcctatattcattctcaactatgggagatgttgtcaaaacaaagtcgtaattcattaacttttgaacattcttgtctctcttcggcccatggtattgaagaaccctggtgcttcccggggatgtcaaccgagaaatctcatctaaccactgagaaagagcaacaggaggaacaagcacaagggtgtgcccaactgcttccctagatttggctctgtcaacttcccgtctggcaagaacgagagagatggcttgtattgttttccccattcccatctcatcagcgagaatgcctcctcttacggctgatagttcctgtattgtagcccaagccaaaaactccttttggtactttagtagcggtataatcaaatctagaggctgctcagcagcttcagcaatgactgcattctgctcatcaaaatcatcatcctctgtcatctgaaccttttctttcatgatctgccattttcttttagtgtttgcaggagcggcaggatttggtatatagtcattagcattgacctcacctgtgtgagcaagacatgatgaaaataaacaggtgtgagcaaatcgagcatcaatgacgcctaatagaaacgatgcggtaccttgaacttcaccgccgactgaatcatcatcatcaggaacttcttcttctttgagattctcgtctatttcaaacaaaccaacgaataattttggtaaggaaacatgagataaattacagtttcccacaagaattgcattctgggaaaacaaaaattggagagaaattatcgatccccaacagatcaattgagcccagaaatagaaaccctaattcacttttccggcaacccgaagattaagaacgaaacccaagaaagatcaacacggagaaatgtcaaaggattgtgaagaagattaccttggctactagacggaagaatcgcattcttgtggtgagagtgtggctccatcgcgacgcccaaatctcaaaaatctcagagtgagttaggttttattgatcttccgctttttttatttctcttcactatcttgttcttatacgagagactgattttgctgtgcaatctttccagaatggcgggaagcaccaaatcacacgtgtcgatttcttcgtgctggggtgaagttttttttttttacgggctaaaaaaccaacacatttttggtttatttcggttttttaaaacatttctgaaataatcgataaccgaaccgaaatctcttttagagaagcaccggtatttccacatcagagaattaacgaataaaaacatatgacaatgtaaacaaattcgtaactgaggatcgagaacagagaatcaatctcgaccttagcgtgtgagtaaagctatcgtaacgtgttgacctccttgggccgtccccgtccacaacgtaacgtgtgcacattcgttctttgagacgactttggtctcagatccaacatggactgatcttaaaccagccatcttgtaagacaataatattcataatcttagatcagcttccacacatcatatatacaatttagttaagcttattaagcacgagaccttacacccacaaaactcaagattctgtatttaccgtaataattatgttcttaacagaaaacatatatctccgttaaagctatagattgttttcacatatataatttgaaatgtatcatgataattacgttgttgatcagaaggagaaaaagaagaagaaagagttaatagctgttagtttcgtgcaagaagctgtagatttcatttttggatttaagctcacgaagaagcaaccaacatgacatgcaatcacacaacactacaacagtagaagacaaggcgcgtgagcatcccgattacgccacgtgtccaattggatagagcccaaaatcttggaacacgtcacatgggttgtccacctatatccatttacaccttgctacgactctgacgtggcagtcctcttccttgtcgtccccacgtggacattcttcgaaacttccattttacaacttgaaaacattttaagtcatatacgcaaatacattaaaactgaataacattttttgtaaataaattttaagattacgcgtaatattttataatgtttcctttattaaattattaaaattaaataagtattatgtctaaaaatattaatttcgaaattctttattaattattaaaattaaataacatgaagtatttctgtctaaaaaaatatgaatttcgaaattccttagctttaataagtcggcaaattttctgtaccaactcgacaaacccatttctcagtgggtcccacgtggggtaacacgtgttacacagataagtcacacgcattacacgtatgtttaaacgacgacgttccaacattcgctgaggaaattatcattttaataatttatttcttatactatttatcgtcgggaaaatatcgtaaaaaaaaaaaaaaaaatcacggaaagcaaaagaaaaatgaaaaaaaaaaaagtcttctttttggctatttatttaaaatagggaaacgaaaatatagcattaaatagatctctctcacacagaagtttcttcttcggcgatctgttcggctgataaacaattttttcttctttgctctttgctaaatattctcaattctaaatctttctgtgggtacaatttcacattctaaacaaaattttaagatcgttaatagttttaaattgtgaataagaaccccaaagagacaaagagacattcccaaaagcaaaacagaaaataagttttctttcg

SEQ ID NO: 229 - DNA, 3000 bp, Arabidopsis thaliana
aaatgagaggaagaaatcccaaaagcaccttttcgtaaatcatctgggtaaacaggagctcggataggtggataactgtcaggcgtttgtggatcaaaaccatcggtggaagaaccgagaggtgactcctcaccaaacatcatagggtcttggtttgggaaggcttcagccatagtctgctgagcatgacgaataacaccggtggcatgatcgtatctttcagccaaagcacgatatgctcgataaaactcctcaaccagtttcataagctcaggccgcttcttgtaatacatttccgctcgcctagcaaaagagtcagcatcttcttcaataaccttgatcatttgcttgactttactatccatatctgtcaacaaaaatagaaacatgtaagcagatcgcatacaaagtatcttgcatgacacaaaactgaactaaaagtaaaagaaatttgtcacgatggaaatgacctttcccgtgggaaatacaagggacgttaaaacaagaaaatcacatacctgtaagattctcctgaagccatttcgagttcttggggcttatgtgactatcccaccaccaagaatagcgtttagagttaccattcacaacagcagtcatttttcccggcaaaatcacacaaaaattatgaggatattagaacactccggaaccaagtctctctcaaagccaagtacaccaaattcctctgtaaaaaaatcctaacttaagaagacgaagaagaagaagaaaatagcaagggttaagctttgataataatgaacaagttcaacagtcatataaaagacaaatacagaagaaaacaaaagaaaaaatagaaacgaattaccactaagtcaatgaaggccaaattcgagacaaaaataattaactagccaaatccagtagtaacctggtcagaaaacatatcaaacaattcattacagatgaaaaattggatcagcataaatcaattcgtctttggaaattagacgagaatcctagggaagaatagcaagtgaaaccacatgatcttacaggaattagaggttatagtaacgcacttagtcggaaactgaaattagctacacaggttaaatctacaaagcgaatctaacactagtgaaatcaggtccaaaagcaagaattctgtgaggcttaccggaaataatacttgtactacaaaaatcagaaatcttcggatcagctttcgctttcacttcttcttcttcttcttcttctcatctcattttcttcatctagatctctctctctttctctctccaggcgtttttcagctctggttcctactttttacgttgtgaagaagaagaattgtttaggtaagcttttaaatgacgatattaccctccagtacagttctcacagatgttctgtttcattattttaattcacttgttgcgtgactttgcctccttgggatcgccttcgctgccaacttaaaaaaaaacacgactttcatgtccgaaagaaaatattcttttatcgaactacaactaaatacagtatgacattttatttgatttctttatttttcaatctgatacttcccatttacccctgatttatatcaagtctgcagttcactttttctttttctatacctgtctgctcaagaactaaaatgattttgtaattttaatacattttattatccggaataacaaagtattaaatcacgaaagatgatttaaaaaaaaaaaaaaagtattaaatactagtaatgataaggaggctgacaagagataagtgacaaagacagggaggtcttggacggtgagctctcggtccactttcgtcaccctttgtttttttctccacgttcgcttttagattcgacttattgcgatcttgcgtgtcaaactttttccaatcatctaaaagttgagtcggagttagagttacgttgttcataacttttatttaaactttgcaagaaaaaagtatatacgatatatggtggcttatcgttatgtatcatttcattcagctttctaaaatttataatttaaaaaataatattataattaagattaaaaacgataaattcaaatttaattgactgagaatgtttttggtgtttggtatgcattacttgtttgacacaacttatatatcatcctttatttgttactcaaacgaagattcacgaaacggacaaataaactatccacctattgggaacaaataggttgtctgacttttaagcatcacaaacggttatatactattttacataaacgtttcgagtgtgttaagattcatttaattgtaaactaaataatcaacagcgtgacttcaaatcaaattgtcttcttataagtttattactaacatatattcttgttcagtttgttgccaatattgaattaattaaaaggattgtgtatattttccttaattgtattgttttttttgtcggttatagaaatgcaaaacaaaaagaaatgaatagaggagtcaacactcaacagccactacctaacaaacacttttaatagttccagctcgtatcgtttttcatgcctccaaagattaattatgattttcaaaatcatttataactatccctccacatgtctttaatagtcaaattgatcttatattaaaaactctatatagtaagaccaagtgaattttaaaattacatcaatgcgatttatatggatgattcaaaagtatttatatttcaaaactgaaacaaggccttgcagcctttcttaatgcttcgtgcagataggcccattaataaaacaataaagcccatacttgtaaaatcaggtaaagacgcaacgcaagcggcacatcagacacatatccattccgaccaaaccatgataaagtatatgccacgtcactattcatcgtcgattagtttttacgaaattgaccaacataccctcgttgtttggttttatctacaacgcagttgctgagtcacacttgttttcttcactcggaaaattcgaaaatcgagatcaa

SEQ ID NO: 230 - DNA, 3000 bp, Arabidopsis thaliana
ttgtaacgattgggcaaagagtgctagctagtcccttgaagtaagtttcttccctgttctgaaatcttgtcagggtattgtagttgtcaaaattgatgtgctctttctgttgctgctccagagtacgattccattacggacatccagatatttttgatcgtctgtttcaccttaccagaggtggtatctgcaaagcttctaaagtcatcaatcttagtgaagacatatttgcaggcactagcttgatctcatattctttggtggtacacatatgatctacttcattttttacattttttctcatacctttttactggtttcaggttttaattctactctgcgtgaaggaaatgtgactcatcatgaatatatacaagttggtaaagggagagatgtgggcctcaaccagatctcaatgtttgaggcaaaaatcgccaatggaaatggcgagcaaactttgagtcgcgacctttataggctaggacaccgatttgatttcttccggatgctgtcttgttatttcaccacaattgggttctacttcagtaccatggtaggttgagattctccctttttatctctcaatcactagatatatacatggcaggtttgtttttctttctcaagactgaagccattatctgtgtgttttgacagttaaccgtgcttacggtgtatgtgtttctttatggacggttatatctagtacttagtgggcttgaagaaggattgagtagccaacgagctttccgtaacaataagcctcttgaggcagctcttgcttctcaatcatttgtgcagattggttttttaatggctttgcctatgatgatggagattggacttgagagggggttccacaatgcattgattgagtttgtgctgatgcagttacaacttgcttccgtctttttcacgtttcagctcgggacaaaaacacattactacggaaggacattgtttcatggaggcgcagagtatagaggaactggtcgagggtttgtggtcttccacgcgaaatttgctgagaactataggttctattcccgtagtcactttgtgaagggcattgaacttatgattcttctactggtatatcagatctttggtcaatcatataggggtgtggttacttatattctgatcactgtttcgatatggttcatggtggtgacatggctctttgctcctttccttttcaatccgtctggttttgagtggcaaaagattgttgatgactggacagactggaacaaatggatttataaccgaggaggaattggtgtccctcctgagaagagttgggaatcttggtgggagaaagagttagaacatcttagacattcaggggttcgtggtatcacccttgagatctttttggccttgcgcttcttcatctttcaatatggacttgtgtatcatctcagtaccttcaaaggaaaaaatcagagcttttgggtaagctaaccttataactacttccctgtgaatggtgaaactcttgattattgaacgataatgactctgttttcaggtttatggagcgtcatggtttgtgatcttattcattctactgattgtgaaggtatgaatctttaagcacattcacatttcaatttcttgccaaatcttaacattgtgttgctttcttctatgtaacgatcattgcagggtttgggcgttggaaggcgaagattcagcacgaatttccagcttctattcagaatcataaagggtcttgtgttcctcacatttgtggcaattctcataactttcctcgcacttcctctgataacaatcaaagacttattcatctgcatgcttgccttcatgccaactggatggggaatgcttctcgtaagtctttctcctccatcaaactcctctatttgtatctaagataccagttttgtctggtttttgtgacagttgctttgttttgtcctccacgtcagattgcacaagcgtgtaagcctctgatccaacagctagggatatggtcatcagttaggacgctagctcgaggctacgagatcgtgatgggcttgcttctgttcacaccagttgcgtttttggcctggtttccttttgtgtctgagttccagacaagaatgctctttaaccaagcctttagtagaggtctacaaatctctcgtattcttggtggtcaaagaaaagaccggtcttcaaaaaacaaggagtgacatgtacacatgtaaatggcgtatgtgtagatttaatggttatctgttattgtttccttcccaagtaatctatagttagaaagttcctgtaactttcatagatatatgttaattattttccatttccataagttcgcgtccattataatagaaagtgcatgagacgtatctttttcatatggaagacgaaaacattggttctccattctaaaagtcaaaaagaaaatgtatatcacttgaacttttccacataggtcatgataaagacaggactaatcaatcattcattgttgataatggtctcaattacctgttgctagttatttctacatttgtatagtgcaatactgtttttttttcctcttccaaataaaaactacagtactaaaagaaagttggtaatcataaaagttataaaactcaaataaaagcaattactctgtttctttttcactcttattttatatgactgaaatgaaattgtctatatgttgtttttgtttgtatgttcattgatatgtaaacatcaaatctgcaaaaaacaaccgcaagtttggatttatacgatgaagcgtttatctagtgagcgtcatcgcagacgtcacaagttatgtggtacaattttgcgtatgtttgatgaatacgcatgcatgtgcagacatcaaaatccaattcctcatctatatttatatatatgtatatatatacatatgaaagcacagatatatccacaaggagagacacagattcttgtattgatactcacttcagtggagctaagacaagtagaaaaaaa

SEQ ID NO: 231 - DNA, 3000 bp, Arabidopsis thaliana
taagatcaaatgcaagaagcaaacataagttatatatcagagttaatagtcaatctcaggtttctcctagtaaatttacagtaaccaagattcaagttccctaatctgatgcaacctcagaatttaagaatcaaatgtccataaactcaaaatagtcctacttaagcaaatcattgacacaaagttagcaacttttgatttaaaaatatcgaacagtgacacgaacaagactaaattaaagaagcttcattagacatgaacatcagtgacagtgagaatccagaggtagagatacagtcataaagagattatcaagaacaggaacaaaaacatccaatacggaagattctgagtcattaaaagaaagaaatcaaattcagagaataagaattattaggcaagaacaaaaaaagaaaataaaggaagggtcttgatcattcttacccagaaaatcagaatcgaagatttacccaattctcggaagaatcatctctttgattcagtatctctaactagtgaagttcacaaccattgatcttggaatcacgaacccaacgctaacagaaagaagaacctttggtgacaagtggtttcgtagtaaatatcacacaacacagaaaccaaaggtcacgaaaagtatgtaaatttgcttgcatacataaacgttaagcaaaaacgccgtcgtttaagtgggagaatcaagaatgaagagttagttgtttctgagttcttcgaatgataaagacaaatgggcaaaagaaattattaaaagtatgagaaaacaacagagtggaaaaatgaaggccacgaatgtttataaaataaaagttggaatgatttgggggataatataaggttgaaatacatatggctgatcttcaattgcaccaaagatcaaagttagtgaatccttgtcaccaaatataagcacattatctttaccgactagccggtgaaaatataacaccgacgaccgaccaattaatatgatacaaataatgaaataagggtcaagtcatctttttttttaattaatttaggttaaaaattaagaaaataaaatgacaaataattaaacgattgtgtcaagtaaaggaaaataaagatcttggaatttaatttaatttagaacaaaacagatttctgatagtaaaccgtaaatttagtggtggctatattatgcagcaagattatcagttaactagattttaatctgcggtataccgcggggttatatcttttttaaaaactaaaaagttaatttgtttagtagattaaataaatataattcattttaatattttctaaatgtacaactcttatatatatatatatatattatttagtatacaattactatgtttattttttactgtttaacaatatagaaagaataacacacagtttattaagttaaaatttagattataactaaataattcaaattttaattatattaattttattaatataatgatattttgatatatatatatatatatatatatatatatatgatttcacccatgatatactgtctcgtattattatcgatccaaagccgtcatatcatctaatctcgttcagtgaaattaaacatatctaatagatttcacccatgctatactgtctcgtattacctatcgacccaaactcgtcataccatctaaccccgttcagcgaaactaaaaattattttgttatttttgttttaataatactttaatttaaaagatatataattcaaatcagtttaaaagttttattttaaatggttatttaattgttttaaaattcatatattataaatattataaacccgtcttatcatctaatctcgttcggtaaaattaaacattatttttttattttttgtttgaataatatttttattaaaaaatttataattcacatcaatttaaaagttttatttcaaatgattatttaatttttatacatttcacatattataaatattataaaacgtttttccgttaaatattttaaatgtttaactaactataatatttatttttaataaagtataatattaataaattcctaagatttctcctttttaaaagtaattagaattgatggaaatatattagataaagaaatgctaataattaagaatattaattagttataataattaaatatcaatgacatccactgtaaataagtcccaacttaaggatttatttactaaaatagctccaaaaatgtatatatagatgttatcaaaattcgaattaaaaagttgtaaaaagactcggaggcggtcaaaatcaatttttttattttcttgcataaatttgtgaactccagagaattaagaatgaccagtgatagagctccacgtggatagattgggttccaaagtgggacggcgttaaatataaaaaggccggaagttgtcgaagtagtcttttttcccattatttctgttttcggttccttattttgttcctttgtaataatgagtgacatcaaaaatatttggggacgaattaacaggtaatgtaaatagaaagaaatagaaaattttctttgattttacaatttggattcggattgcataagcaatgacatcaacagtaatacatagctgagaggctgagatgcagtgtctctctctcagggaagatgacaaaaagaatctgatatacacgtacgtatgttgcgagttacatattgatatatcacatgtcataagtcacatgctaacgataaactaataaactaaaacaattatgtcaacatatatcggtgaattgcattatcatcgacctcggtcactgttccgcacatcttggtcgccacggaacatagacaatttttggattgtagtccaattaatgagtcccccaccaaagccgtagtaaaatcgaagtcgttctctaatccaatcatatatatatccataacacacaccaacaacacccacacaacaaaaactagagtcagtaacaacacaagattaaaaagaaggagaaa

SEQ ID NO: 232 - DNA, 3000 bp, Arabidopsis thaliana
gctcttcgaagaatgagaagtttgattcttaagaagagatgagtggggttaataaggaaaggttatcatcggaaaaaaaggaaattaaggtgattgatcacgtggctataatgaattaatctgattgcccaattaaaaaaaaaggaaatttataaatattaatttttaaaaaatatatatataaatattaattttgatgaaaaggaatttgtaaagaagcggttctcgtaatttttcttcggaagttgtcaaagaaccggcagatcctcgctgctcttgcattcgctcactacggtaacactctatcatctccatctctgttttgaattcgagattcgaactcaaagatttcgttttggaggattgcaatcttttcaatcaaaaaaaaaaagtaaaaagattgtaaaattgatcgttgattgggtgcggatgatctttggtcttcttgagcttaacttgggttgacatcagtttactgttttaagagatgaaaacccacaaggcatataacttttctagggtttagggtaattatattttaggatcaatcttctcgaaaaggaagaaaaattgaagcttgctatgtctctttaccttgagatatgagaatcacaggtcaaattatgttcttgatagattcagttgttgagttcatgtgtggtgttggaagaagtcaaaactctagttctagatataagcttgaaatttggacatgattttgtagatgtaagcttgaaaatggtttaggagagatgttactagatgcttccttatgccttctctgagactttaacattttgttgacacttttgttcttttttatctacatcttttgaatcatttgtttaaagcttttgcttaactcaaaagtaatttgtctcagcttttgcttaatggtgcctttttcctctggcaaacagatctcagactacagttaccaagatggtgtacgaaataactgagcaaaaaagtaattatttcttcacaattatcgctgtatagctttttcttgtgctgtttctgatgtacaactcttttggcaacggattttcgttagttctaagcattttgtcggtcctgtcgttcacttgtctttctcttgtcttataaacattactgaacagatcaaggtagatactgggtcagatttctttatatacgtgttatatctcttctttaggaattaaatcagtaatagaaatcacaaacttcatttttctttgtcttatggcttccatttcctgaatgtttgcagaagttgggttgggcctcattggttttggtttatcctttacgtttctcggagtcatcttgtactttgacagaggtttgctcgctctaggaaacgtgaggatatccttgttatttctaaacattaaatctacacaagggtccaacatttgagtctcatttggcttttgtgttcagttattctggttgataggtgttggccttttacttggttggcagtcgacttggagagtatttacaaatgttaataacttgagggtacgcattggactaattctaatctctgttaattgtttctcttgatgaacctttcatatggacatatcaatatgttcttgcaggggactatctgtttcgtccttggactctttctaatatttgtacgttggcccattatcggcattatcttggagatatacggtgtcattgtcctattcgggtgagtgcatttgtttctgttgctcatagtttcttatcgagtttttcacacattgtgcttttagatttgacatattaaagcagactgaaaaatgagtaaactagtggttctggcacagcacactaggatcttttgcctacagaatgatgatgtttgactaataacaatccatatctgatgaactcatttcctttcaccagtcacttattaattttattcagcttcttgcttaaagttttagcctgttacagtgtctaaccaacatcacatgtactaactttgcagcggattttggtcaacagtaaaggcatttctttcccagattccttttgtcggatggataatacagtatcctctcatggtaagtaatccacaacaacacttgccttttcctctaatgctcctttcttatgctttttgtacattcagagcttcctgtcagggccttgttcttgaacaacatcccgtgctcctgcctcaatttattcagtcccttgtggtagcttaagttagcctttctcggaaatggatagacccaatggacgtttcctgatatttagtttgcacatgatatagggatgaacataaaatgatttagagcgatggactgaattttgttttggaatgatctgtttatttttgcaggttcttgagcaacttgtaagaggtgctcgttgaaaaagatcaatctcaatctcatggctcttcagccgcttaacgacatcaaagcctttctttcttttttgggacatgacagagactttgctctgttttttgtttttttggtaaacctcacctttgctctgttttacatgtctaattttgctgtatatgccaaaatacattttcccttaaattgatttatcttctcgttaagcaagtattttcaactataactccaatcttgtgccaaatttaatcaaattcagatgataagtttttttttttaaacctccaatcttgtcccaactcaattttcattatgtaacgtgcggataataattaagtagttttgtaacgaatcaacgacatatttaacataaattaaattttaacagaataaaaagtgttcacgttattaaattttgtttttatttgcgtacggacataagttcctaaatgtgtcagccaaagatcaaattgttttcaggatcagacagagatcatcgagtgcggatttttctcggagagatgtctcttcgtgctttcttgctcggcgaggcattgacctaaacccgcttaataatctccgacgaagatccaggacacactcggcgttaagaggggaaagaaccaaaaatcaaacaatc

SEQ ID NO: 233 - DNA, 3000 bp, Arabidopsis thaliana
tctcgagaaccctcaagatgtggaacaaaacatggcatgagatgttgtgaaccttatttaataagcttattgtgcaaagcttgtaacttaaagttgtaatcatggtccttaccaagactcgttctagtgtccgaatcttgtcgagattgtgtaacttgtaaccttgtataactctaaaatgtaggagactgaggaagtcatcaagataattgtgaagatttcgcaattgacattttacataacgtctctttctttgtgaaacaagattgtgaatacaatcatgattgatattagtttccattacttgttatcgatcgagcaacattatcaagtcgtttagtgtcacgataaagacaattgagcatgtgaaacaacagacaaagataattactctactaatgacaatcaaggaaacccatttgccaaaaacgtcgtcgttttggaatgaaacaacagctcaaaccccaaaaccgtgttgggacggtaaacagacccctccctgctcgccggagcactactcggcgacttcagatcttctttcagggttcttccaggaattagattgtcaacgaatccaatcttctgaaacaaaaatcttcggatgcgaagatcgattgtgattgtgattgcgttaacggcgaaggggtttcttcatcggcatcttctggagaaaggtaatcttgtaactgctctctcattacgcatttgcaattcccgagctttttctggtaggagtgattaccgagagagattgagaagtgggcttcactctattaagtttaacgatgcacttactttgttctgtgacatggctgagtctcatcccctcccttccattgttgatttcagtagattactgattgccattgctaagctgaataagtatgaagctgtgatctctctctttcggcatttggagatgttgggaatttcacatgatctctatagcttcactactttaatagattgtttctgccgatgcgctcgactctctcttgctctgtcatgtctaggaaagatgatgaagcttggttttgagcccagcatagttacctttggatctctggtcaatggattctgtcacgtaaatagattttatgaagccatgtctctggttgatcaaatcgtgggattgggatatgaacctaatgttgtaatctacaacactatcattgatagtctctgcgaaaagggacaagtgaatactgcgctggatgttttgaaacatatgaagaaaatgggaattagaccggatgttgttacatacaactctctcattactcgccttttccattctggtacatggggcgtctctgctcgaatactgagtgatatgatgaggatgggaatcagcccggatgtaatcactttcagtgctttgatcgatgtgtatgggaaagaggggcagcttttagaggctaagaaacagtacaatgagatgattcaaaggtcagttaatcctaatattgtcacttacaattcactgatcaacgggctttgcattcacggtcttctagatgaagccaaaaaagttcttaatgttttggtaagtaaaggtttcttcccaaatgcagtgacttataatactctcataaatggatattgcaaggccaagagggtagatgatgggatgaaaatcttgtgcgtaatgtcccgtgatggagtggatggtgacacattcacttacaatactctttaccaaggttattgtcaagcgggaaaatttagtgctgccgaaaaggttttaggtcggatggtttcttgtggcgtgcatcccgatatgtatacctttaacattttgttagacggtctatgtgatcatggaaaaataggaaaagcattggtgagactggaggatttgcaaaagagtaaaacagttgttggtattattacatataatattatcatcaaagggctgtgtaaggctgataaggtggaagatgcttggtatttattttgcagtcttgctctcaaaggagtaagtcctgatgttataacgtacattacaatgatgataggcttgcgtaggaaaagactatggcgtgaagcgcatgagctgtatagaaaaatgcaaaaagaggatgggcttatgccaattaagtagacgtataaaagaggtaaatatgagacaccttagagatagcgagttaagggttcaccatcaccacagatgcgtcttaattttaagtttggctgttgtatgatacgaaattggacaaacattaagctaggaggcatgatggatttaatcatattttagatgggaatgagaggatattaaggtaccaaccctcaaggcatattgtagactggtttggtttggacatgtgaagagttttgaagctgaagtgtttggtcactctagcattagatgttgcaggtgtagttttgtacatacatgtaaatgatgtctctttcttacgcacatttgttgacatagagaagctaatatttgcttaagcatgttgtaagctgtaactttagaatttaacctccactgtaacatattacatatgcaatcaggcaaacgaagattcgatcaaacgggtcattgcaaatccagaagtgtgagaagattgaccattaggaaacttataaagtggttcagtcttttacaaattaaatttcctgtttcaaacaccaatcaaatccaccgaattaccaaagatttcatgtttgcctctatccataatggttggaaaattttcaattttttaagtaatagtttgatattgtggggaaaaaatactattctaaacggtagataggtcttacacgtgagcattccgtaactggacaaggatcaaccaaagagaaagcagggagatccatcacggaacattatctttgtaatcaaaatctgatcgtacacgtgtacactatgatgtccactaacagtccacatctgttgacctgacattctcagacacacgagaggatcttttttctttctaacctctaaaatattttaattttaaaataaaataataaaatccgtat

SEQ ID NO: 234 - DNA, 3000 bp, Arabidopsis thaliana
ttagaagcttttggagaagttatgctgtattataggatgttgctgggagatgaaaagtttattttctacagagagatggggttatctttataacctttcttttgtgtggaaaatcaagtaaattttgcaagagagaaatcccttagaatctaagtcttgtctatttacgtttaatgctgaggatcgcatgtggaaggttttttaatttttgtattggagcaataatatgcgtgaagtgaaaaatcttgagataccttgaaagtatcagtcgtacacacaattgaagcgttacgaagatgagaaacgttatcaaccttgttaaaacacaactgtggagagtttagaattgatgatagatgaaaagttatagggatcaaaatagagagctaatatctttggtgtggtggcgagaaaaatcatctgaaaagatgtttcatagatttgaggtacgaatctgattggttgggttagataaaggtcaggtcaggtggctaagactgaattcgactgtcatcaaaaaggagtgtccactacggtcagcaaaagaaaaaggactatgtaggtgaagtgaatccgatgggaaataaaacaaatgtgatagagagagaacagagacgccaattatgagtagagctgacacgttggagctgactctgtctctatctctatatctctgtctttctctatttatagatggagtacgtacagctgctccacactatatatacagtacatactttgaaaagtatatttgagttacgtcttcaacttcaaagcgtttcttactactaaagtggtacgtttccctaattcgctctcattttccatcttcttcttctccttcttttgaaaacacacacacaagttcgatttattttcttagaatcaatgtggtaaccatatttctagatgacatatcttgcctaatgcttcaattaattggagacatgatgaattttaactgtaaaaaaaaaacaaatgaaacattgaacaattgatataggaatgaataatttttttttgaaaaacaaaagaaataagggaaaaagctctatttggtagtatataataacctaagattatattcattattgtatttgcctaaaattagatttagtagtatattaatataattgactgattttatggtaaaatatatacacattctaagtattactaaaatattcaacatacaatagagagtataaatacaatcattatatatgagttagaggatcaccgtttgtgtgtgaatactgaagaaggtatgttttcaaagtagatctctcgatgtgtttttgttttatagtcatgatttctcacatagtcacatttctgtgtataggttacgtacgtgtgtttgtaatgtcattaaacaactcgtttgggtgttttcatatacgttttttttgtttttgttttgagtttagaatattatctaattttcatttagtatatataagggatgaaatgtgaccggacaccttagaatttccacggtatctgaatcaatttactaattgaaaatttgatttgacattaacgaatgataaagctttggttcatcgatgagtccgagagtaataagaagacaacattctcgtgaattacttctgcattgggacacgtatctacgtgtgtttcccacatagaactcagtttcatccttttctcgtgaacattactttcttgataatagttagtttctttgtctttatcaaaccaaacaaagaatttgtcgttttcgataatatttcattttcgtcgtttctttctttctaagtttcgatgtcagttcctaatctctatggcgttcatgatagccaaatggtaactttggtggcctaatgtatgtcacgtaaattatccacgtggcactcacttttttgcatctttctcaaaatatatcaaaggagacttcataaagaaagaatctttagtgtggagagactaaaaggttctgtttcagattctcaaattttttttttttattgaaaaagatctttgaatctcccacacccattcgaatttcctcttatgatttaggagattctgtgttagtatccttctttttgttgtttatttctttatttctctgccatgtcgaaggaacatacaaatctgaaattcttcttcattatatattagcttcacggtccatgttttttctgttctaatttttattattatgtgttaatttgatctcaggacaccacaagcttatttcataagaaacttcaaattagaatcagaaacaagagcatccttcttcatttacacaggtactcactcctctagtttcatttagaattgtgcttgttttttttaacacaatttgtctcggctatctgaatattactctttaacattttatttcttcgaaacctctgttcttaatttactaactgaatcttacatatttgattactttagattacttcaggggttattatttaaaattaattgttatttcataatgcatgagcatcattttcatgtctcaacagactcaacaccatatttgttcttgtctttttatattttaaattttttcttcttcttacattccctattttgatattatggttaatgcttttactatatttcacattggggggagtgaatctaaattatagtctgaaatattcctcgtgatattctcctcattccattttataatattgaaaacagagtacttttgtgagattcgtacggacatttgcaatttagtaggagagtgattttgttgtccccaagaccagttcaattctaagatgatattatagtattctttaaggttcttccgtcaaactgttgaaacaatttcttgataataaattataaacaattgggacaggagattctcttttcttgattcttcggatagaattatttcataggtcaaactcagactaattccgacgttataggtgttggtactcaaaagtgttcctagggttttctcacaaacaatatcttataggtaaattaggtgtaaaa

SEQ ID NO: 235 - DNA, 3000 bp, Arabidopsis thaliana
ataaacaaaccaccgcactaactcgtcgacgacgcgttctcaaatctgacgatacgaactcgcccgaagactcaaacgtgactatattttaccttaatgcgctcgttttttctcagcgatccgaccgacacaattttttgggcaacgcgctttcgactagccggaaaaccaaatcgtcctagtcccccagtgtgatctagttacgccaccacaggcctgatagtattaaaacaaaagggcgaaataaaacgacgacgtttacgaggagcgactcctcgggatccggtagccaatagtaaactcagatcacatagatcttcccgagccctagcgatttcgatttctaaagcagattctaaagacaaaaatcaggaaactcgaggaagaggaacctagtttcgaaacaaaaacaaaaaccagagaagaagatgatcaacgagaatgatgaaatcggaaggaaaccttaccgtctctccgacgaagaactaacggaacggagcttgagattgagcgacgaagaagcagcgatcgagagaaagagagaagtgcaaaaactaatcttagtgaaggccaagtatggaaatgtattaatgtgttcaaacacattaaaattgaatttttttttaagaaaaagtatggtactgagattcagagatggtgaatatctgttgtacctaacagcaatttagtaaactataatttctgacgactatttttcgatacttttgtaacaattatcgtaaaaaacaaaaaattaagtgagattacattcgacgttagatgccagaaataatatatatatgtgattgtgaatatgtacctttttttcttttttcaatgagtgtaatatgaatgctttgagaggattacacgcgtgattctgattcggatcaccaacttcttttgcttcccttttaatttctttcctatcttttgcttttcccattcatctctctcgctttccacaaaggcgagatttgaatacgtaatcctaattatactctcatagagatttggtaatttggcccaaaatatctttctactttgtaatatgtcgatgcatagaaaacataatcttattctaacattcacaaatctcctatatttccatattgaatctctcagtctggatcggtttgtaatctctgtccagctacctcttacgtttcaggtgtttctatgatttatccattggcttcattggctgcctataacttatatatcatgttgcaatctttgtgtgtgttgtgttggggagagcttatagccggccgctcctccattagcttccaaatggttgaatcagtctgtatcagatttaaactcagtgatagcacccacgttatgcatgatttttaagatttgataagcagactgtttttaacttcaattcaagagcatcatccactttcggcttaatatcctatattaatttctttaacaagctaaaatgaacataatgaaaataactacactcactgattggcaattactaatatctcaaaacattaagaagtattttttttttttttgggtgaaaagtcactgtctttttcttaaagccaaaatttatacggaacgacaaaacaaaaaatatgactaaaaacttcttaagcgcaatcactgaccatgcagcctattttagtttttaagtcttttatatacattggctgttatagtcgtaaaacaatcaggtatttgttatggagataacaatttgggaacgcataaatagtgcctctgatggttggaagtggaacaaaatcacaatatttttttctagtgtataaacaacatacaaatatcatgtcacctgcaaagagaataatatgccaaaattttgatataatacgcataacagagtttatatatcaacgttctagacttataggtgatcatccattatctttaacctcttgtagctagctaggttaattaggagatgcatgcatctagataggcatatatagtctaacattacaaatccatcaaaggttcccttcttcttctccaaagaaattagctacatacaaatttgacagactctcataaatatatatatatatgtttatagattatattattaaaaatacaaatgatattttctgtattttgttaaaattagttcttaagattttatgaaatttataattgagccaacgtcttagaaataattatacgacatacgtaatttaaattcaatgacgatgacttaaacttaatgttttacagtatttatccaatcaaattttaccacatcagcagagaagagtcaaacttaggaaaagtctatcttggattatcctgacgtggcttttttcaagtaagaaataaattaatgctaatcacgtacgtacctacccagcttttggacctcgtgggctatatagaaaacaagtaaccaaagagagacgaagcaaaaacattcagagagaaaattcagcatttttgatagctcaagcacttgattctttccaaaggggtttcctgaggtatgtttgctttcctttttggttttaatttgtttcaaatcttagatcgattcttcactttggattcttaaatcgattcttgtcctcgtctgtgctgatttcgaacttttccgattccaactccgccgaatctacgtatagatctttgaggaaatgtttttttcgatttatgatcggcggatctaccgattcctttgcttgttttctttggatgtatcacactcttctgaagatgccttgacctttttatgtgaactagtaagagttattatggcttagatcgttgaatatctggtatatgtgttcttataatgggattaggatctatgttttggtgcgtattaaagcttagttgagattgatgtttttgggttttcaaattctgtttcttgtctgttgagctaatttaatgttgtgtagaaccatttgtttttttctggatctttacttatttgtatatgtattggtttatgtttatgtttttacagatcacaaaggccaagtaaca

SEQ ID NO: 236 - DNA, 3000 bp, Arabidopsis thaliana
ctccttaactgcttggctgcgcttggaaccctccttaaactgcctccggcgctccttggcctaaccgttcttgcttggggaaactcggttggtgacctagttgctgacgtggcagttgcaaaggcaggtagaccagcaatggctatggccggttgttttgcaggtccaatgtttaacatgcttgttggacttggatcggccttggtgatgcaaacagctaatgtatatccagacgcttacaaacttggattccatgtaggtattgtgatagctttcgtcttcttgttgcttagtctaatgggatctctgttggtaataacctggtctagattccgagttccgagattctgggggatctgtcttgttggactgtatgttgctttcacatttgttagtttgatcatcgccagcgtttcaacctgatcatatgcgtgaagtctgcacattgaataatctagggtcaaccagggttcattgtttaggaatttttgttgtctagaagggaattgccaaaattttgagctcagctgatggccaccgccagaccagtaatcttcgaatcccacaaaaagttcttgtgatcgtccgagccagattagtaaagtttggtagataggtgatggtaaaatatatgtgctttgggagaagattttgactcccccatctggtttacttttccattgattgtactggtcttgtttttttgggtctgttatatatgtataaaccacacatttgtattcttttgatattaatgagaaatacttcattgatcctagaatgtgtattagagcagaacaaaatgttgattctggttcttttttatgtgatttgattctctgtgaatgccaaatatgttgtgatacaacaaaactacttgtgaaatttgaacctccaaagaagataattaaaggttgccaattaaatcctaagaagataataaaaatgaattaattaatgtaagagataaaacaaatcatgatctgacaagagcagaagaatcttgacataagcccaatggttgacacgacacccagcttttaaagctctttccacttacttccccttgtctttctaaattcctcctcattgttaaagtcgaaaaaagggtaaagcagcaaaaccctaataaaatcacaacaaattaacacaaaaaaaccagatcttaaaactctctctacccaccaagaggatcaaccagtctcttccccttcagattctcctttccacaggtcactctcgtttgcagattctttttttcaatttgacttgttcttacttatatattgtggaattcacatgataaaataatatgcttggtgttgtaggaacaattctagttgttctgtgttagcagattctttgttctgtctattttgaaggaaattaaaggcaatccctttcgatattttcctgttttccttatcaaatttatgggttggaataagtaggttgatgtattgtcttttaattcgaagctcaattttcatacttattgctgtttagatcttcaaggttaatctagaattacagattagaccatatataaagtaaattcagcagattcttatttatgtaaattgtttgttagcaaccttatctccttcacatttctttaaaattctggtcagatgtttcttaagagcttagaatgaatcccaaagttctgtttttttattctggtagtgaatggatcaacaagaccatggacagtctggagctatgaactatggcacaaacccataccaaaccaacccgatgagcaccactgctgctactgtagcaggaggtgcggcacaaccaggccagctggcgttccaccagatccatcagcagcagcagcagcaacagctggcacagcagcttcaagcattttgggagaaccaattcaaagagattgagaagactaccgatttcaagaaccacagccttccccttgcgagaatcaagaaaatcatgaaagcggatgaagatgtccgtatgatctcggctgaggcgcctgtcgtgtttgcaagggcctgtgagatgttcatcctggagctgacactcaggtcgtggaaccacactgaggagaataagaggcggacgttgcagaagaacgatattgctgctgctgtgactagaaccgatatttttgatttccttgtggatattgttccccgggaggatctccgagatgaagtcttgggaagtattccgaggggcactgtcccggaagctgctgctgctggttacccgtatggatacttgcctgcaggaactgctccaataggaaatccgggaatggttatgggtaatcccggtggtgcgtatccacctaatccttatatgggtcaaccaatgtggcaacaacaggcacctgaccaacctgaccaggaaaattagcaagaaactgtgagtcttccagcttcttttaggcctaccttgtagtcttggggttttgtttctgttttcgaataatggtaacctttgtataacttatttcagtatcgtctcagtttggtactatgtcagttttggtattcttatcttattgaagtaaaaatgtgatagtgtattcgcttttctccctgcagcgttctagtctcgtccaggtgaaaggagggagaccttagacaagaaaatgaaaagaacatatcagaattgtcaaattgggtgttgtagaagaatctaaagtgtttatgtctatcgatccttttctaaacgagaaatttagggatgaaccagaaagaagaatgtataaactgtaagaaacaagtgtgcttttgacaaaagtttttttatttgaatgttaatttctgtgtctttatcacacatattaagttattatccacaaaatgtatctcattggatatttaaaacaaaaggacaataatattaaggaaaagacaaaatagaaaatgacttggccactgtagccgcgttaataatgtgatagcttttatctacaagaagcgttacttggtcgtcatctaccttctcagaaagggagctgcatca

SEQ ID NO: 237 - DNA, 3000 bp, Arabidopsis thaliana
atatcttattcttattcctggaagatatgagcttgtacttttcttgaattagccatagaatagtatgattatgtaatttgatcatatgatgtcacccagaagtttattatctaaggccatttgtaataactttttatttgggacataactgatgcaggaggatgcagttgatccgaagagcaggcacaaggggaagctggagactgagagcttactgcaatcaaaaggtgtaaactggacttctatacgtcctgtctacatctacggtccattgaattacaaccccgtcgaagaatggtttttccaccgtctaaaggcaggtcgcccaatcccggttccaaactctgggatacagatctcacaactcggtcacgttaaggtcagtcacactttctctaattcttgagcttcctttcatgttcagaaaactcattgttatagggacccactgactgaaactcagctctgatcaatcttgaagagtattgatcaataacatcaaatcattctgtaatttcaggacttggcaacagcctttctcaacgtgcttggtaacgagaaagccagcagagagatattcaacatctcgggggagaaatatgttacctttgatgggttagcaaaagcttgcgcaaaggtacattcttttctattggctttattgttgtctcatcaatccaaatcgtttcaagtacatcctggtgtggtccgtttgtaatagatatcatactctgagctttttggatcattgcttgagtaaacttattcatgttttcaactctctctcaggccggtgggtttccggagccagagattgttcattacaacccgaaagagttcgactttgggaagaagaaggcattccctttccgtgatcaggtaaaaaccacaacgttctaatgatcgaggctgcaacatgaacgattccaatttagaagttgagattttgatatatgtatattctcttgcagcatttctttgcatcggtggagaaagcaaagcatgtcctcggatggaaaccggagttcgacttagtggagggtctcactgactcatacaaccttgatttcggtcgcggaacattccggaaagaagcggatttcaccactgacgacatgattctgagcaagaaacttgttcttcaataatcgaaatcctaagagttgctcattcttggcttgtatgattctgatcacccggttctcttaaagttctgaactttattgtcatctcacgtatgttatggtccggattttgttcgacttttctctaaagaagtcaagctagggacgatgaagaaaccgagaaagtaagtacacgagaaagagacggtctggctcttgacttaggaacttaggaattttggtatcaattcgatatcctctttctaaatctgaaccgaaccaaaattacaaccataccgactaccgagctaattaaactttagttttaaatgcgggcccctttgtatcatatagcccattaaccgatcgaaccgaaccaaaaaatcgaattcgcacgactaaatacagatttgacccgtgcttggttatgcccgctacataccggtcaaataaaaactcatttgggctccaatatttaaatttagaagcccaactcgtaattgaaaagtccaacttgtgaatattattagtttttttttttttttttcatcaaatattaatagtttatagagacatatttcattggttgtaatttacttatcttttggcctatttttagtgaaaaaaatgattagttgattttttaaacgtctgaaacttgtattagtgattaattgaaaataaaagaaaagaaatgtaaattctattactctattggttatctaaatgtaaatgagtcattctccggaattttgttttatgttttttttctctcgactcttgttggatcatttagttctcactgcaagtcttaatcttgtggatagaagaatcttacaaaattcttgtgaaatttagattccaaagaatatactacgaaaaaagatttagtcttcttcctattttttgtttggtcaggattacttaaagtcgtagctccatgtgagtttataaatatcatcttattctttctctttctcaacatatgtcggtacgtctttttcttttcacgtatgtcggtacgtcaaaatgttatagtgctactcttagattgttacattcatatcaacatcagaatacccaacaatactacatacatatatccaactagtcaaatactctataaaaaactaactaaacaattcaacagacaggataaaaagaaatttggtagtctattgagcattttggcttacaagtaaaagatcttgaaacatatcaacgtaaactaataatgcatatttttaccaaaacaaaaaactaataatggatatatactataacattttggcttttggccagttaacaaaaagaaaaagaaaaaaaaagtttagaaatattaaaattatgacgttaggacaaaagaagaaaatatcaaatttatagaaaacaaccactacataaatagtaggtcggccatgggtcggacaaaatagattacttaacaattaacgagcagcaaattagctttgggtatagtaacaaccaatcaatgttccctcagcttcttcttcgtgggctccatttaggccacgtggcattatcacagccttgtattgaattcaacggagatccttcaaccaatcacgagatttcgttagcgctggtagggccctctctcgctaaacacatggggtagtatctaaagtggacctgtcacactgcatcgccatgtcatcatttcgggcatcttcaacttaatacgaacttacgaagctttccccggtggataattaaccgttttattaattagccataatcacggcctcaaagcctatataagttgtttctcaccaacaatcaaatcacttatcaacaactcaaaactgatcatcacaaagaaaagagttttctctgataatctttctcggacaag

SEQ ID NO: 238 - DNA, 3000 bp, Arabidopsis thaliana
ataatcttaatccttcatacactggagggtactgtctaactattttaaaatgatctaaaatgatttcatcgctaattcaacgcctagaaaaggcaactaatatcagcatcgacatggagacaataatcttgaaacctgatttgtcccacaagttttggttgctagaaagatcagcttcatgctgtttttttgcagccaattgctcgttgagtacttcttgtattgccatatcgtttcgctctcccatctagcatcgcacagaaagaacagctcaaattggtactgtattcataaaattactatccctagtaaaagcaagtgagtttaccttttgaagttttcgagtttggatgcgtgtttcgcgtaggcaaaattctaacttcagcaccttcttcttcagctcctgatcaattctcctttgattctccacctgatccagaagaacaaaggctttactacataaaaccaaaaataaatcacagaaataagagatgctaaagcatgtgttgttacctgatcttctaattcctttgtcttaaacgtccaatgagccgacataatcttcagttcatctctgagagtctgagtcttgcaatatcatcatctttagccgtcaaaagttatttagcttcggagttaccgagcctagggcttcgaattttgtatcatctaaagtaacgaatccttcgctaacctacgcatctggcgcagtaagctaacttgctaggtttgactgtagcgcggcaaaatctattcgttcaaagtgtagaaagccacgtgtgcatagtgtttatcgttagtggtcgcacactaataatcttcttgtcataaaataatgttgttgttcgttttattgccgcagacgctgccgctgccgcaaccgcaggtttatttgttcgttttgacgccgctacgataattttcatgtaattcttttatttacttttctagttatattctgaatataaaaaaatgtaatttaaatatatttacatccataaaaaatatttgtttagcatgtaatagtttttagctttttttggtaaggagtaataattttaaatattagttttctgaaaaatgcagaaacgattttaaatacaaatggaacaggtaaaggattgggataaaccatctttcctaacaaaatctgaactcgtacaatatagaattcagtcttgtttgatacaaaaaaatcataaaaagaacaaagcaagtgcaaaaattcttagaagagaatgaaaaaaatggaaacaactcaatagccacctttgagatcgttgacaacattgggaatgggagtgacagtctccaaggtcataccttcaaccatgaaacaaggtttaggacctttaggttgtctcttagtgctaatagtctcacatctagctttagcagcagtcttaaacacatcgttttgcttcttcctgagactaaactcatcatcacaccttgactgttgcagccttaagcacatcgttctgcttcttcctgagattaaactcctcatcacaccttgactgttgcacatgctccacacgtacatgtatcctcttccttataattctgtgcttaatctaaaactcaacccaaaactcaaaattagctctccaagagattcaactaaatgataaacatcaaagtcaaaatgaaaacatcactaagaatcatagtagattgattgcaaattatacaagtagcaaaagaaggacccaagaagaaaagcttgaagctttcaaaccaatactaatcacacatcacaaaattcaaaacagatagctcacacaagacaattaaaccccaaatcaaagaatcaaaataacgttcaaatcctaatttcaacaatcaaaactcttccaaacagatgagaattttgagtaatcgaaacctgtttgttgacttcaacaccaacggcacgcttagtgagattccagatacgaccaatacgactatggtagaacttatgaggaatacccttgtgaatagctccattaaccttgacatcgacgtaatcgccgaccttgaaggttatgaggtaagtggagagtggaatataacccttcttcctgaatggtctcgcgaacagatctcttgttcttcagggtcaaccagagaacttctaaaacaaaacccattacttcgaaatcgccgagtttaattcgaaatcgctgagctttactttttcagatcgaaatcgtgtaaaagagaagaaaagtttcagatcgtgaatgtgttaggttttagagttaggttttatcgtgggtttctaaatatgttaagggtatttctgtcatttggcatattaatcgcagttttttaattttaacgctgaatttaatcagcgtttaatttttttcgccgcataacattgcgtcggccgcagcgttttgccgcagctatctgcggtagtgaaatgaacagtttcatctgcgtctaccgcagctgcaactacctgcggcgacgaaacgaacagactaaatataaataaacataaaaattaaaagcacaaatgaattttagtatgtgtaattatgtatagtagtaattactcatcaatcatcttaaaaacctttttttctggtgatttctagttttaaagtttttacctatgattttgtcttgaggatgtctaggctttacaatatattgaaatatttatacatttaaaataaaatctataaaactgaaagaaaataattaatattctgaacttcattttttgcattttgtgtataaattaaaaaaaaaaaaaattactgctacgtgatttgttgaaaaaattaacacgtggggtgttttatttttgattacatgaacttgtgaaccttgtttctgcttacaaaaactgaagagcccatttcaaacaaggcccatattctgattgagcggccctattttaccaaaccacctactaatgaacactctcaagtcacctcattcgagttggaagttccctttaaaacaattattttcagacacagagagactcagacaggagat

SEQ ID NO: 239 - DNA, 3000 bp, Arabidopsis thaliana
caatatattgaaatatttatacatttaaaataaaatctataaaactgaaagaaaataattaatattctgaacttcattttttgcattttgtgtataaattaaaaaaaaaaaaaattactgctacgtgatttgttgaaaaaattaacacgtggggtgttttatttttgattacatgaacttgtgaaccttgtttctgcttacaaaaactgaagagcccatttcaaacaaggcccatattctgattgagcggccctattttaccaaaccacctactaatgaacactctcaagtcacctcattcgagttggaagttccctttaaaacaattattttcagacacagagagactcagacaggagatatgaactgcggaggaaaggtggtctgcgttaccggagcttccggctacatagcgtcttggattgtcaagcttttgctcctccgtggctacaccgtcaatgccactgttcgagatccaagtttgttcccaactctctctctcttctttattttaaaaaacaaacgactgcaattattagggacgattatgagtagcacaaatagaatcaaaatcggaatctggctgaaaaatctgacggaatcaaaccaattatgtctttacttaaattacatacataacatccaaatcgttcttttttttttttttgagacaaccaaattgaaatttgggactttgattagctgttgtgttttgaatgatgacttattaattagacaatatttttccgacctttataattaaattaccaaatacggaaagttcagagaactcattcaggttcgtaccaagttttgacttttgagggtacaagtaaaatcattcttttgaactttgaactttgaagtgcatgttgacgttatactcttcttcagaggacaagaagaaaacagaacatcttcttgcactagacggtgcaaaagaaagactcaaattgttcaaagcagatcttttggaagaatcttcttttgatcaagctatcgatggttgtgatgctgtcttccacactgcttctccagttctattcactgtcacagatcctcaggtttgtcagggaattattttaactattaatttgcaaagtcatatgagttaaaatcaaaatttgtgtttcttttcctattagactgagctgattgatccagccttaaagggtactattaacgtccttaatacatgcaaacaagtttcttctgtcaagagggtcattctgacatcttccacggctgcggttctctctcgtcagcctcctattgggccaaacgacctggtggacgagactttcttctccgatccaagtctatgcagggagacaaaggtcctttgattttgttgtggacttatcagtttcaagagttcggattctttcttacacttttcttattttcttcttcagaattggtattcactctccaagattttggccgagaatgcagcgtggcaatttgccaaagacaatggaatcgacatggttgtgttgaatcctggatttatttgcggaccactcttgcaaccaactcttaacatgtcggtagagctaattgtggatttcataaatggtaagaaccctttcaataaaagatactacaggttctcggacgtaagagatgtcgccttggttcatatcaaagcgttggagactccttcagccaatggcagatacatcatcgatggtccaaatatgagtgtaaacgacattatagacattcttcggaagctgttcccagatttgtctattgctgatacgtgagatctctttccctagctctacctttgcttatcatcttatgaagtttataaatttaatgaaagattttgaaaaacttacttgttgatgattttgttaggaatgaagaaagtgagatgaatgagatgatatgccaagtgtgtgtggagaaagtgaaaaatttgggagtagagttcactcctatgaaatcaagccttagagacactattgttagcctcaaggagaaatgtcttttatgattctgttcgtatatttgtaactattatgtgtatttttattttgttagtattactaattcaagtggtttaagttgttgagactctttaaaatctaagcattttataaacaataatatataattattgtttaggctaaatttgtcactaattaaggtttggatacatagtgtctaaactaagctaataatatcacttaacgtttacttgtaacgctaggtgatgatgtcgtcaagtcaattggtacaaggaataaacgagtggtcatatgacattatgaccatatgaattcaaactccagtaatccaatggtaattggattcaatgatcaagacttgaaccacgtaatccacccttatccttagaagctcataaatatcactaaagggacaggcaacacttaaccagtagttgtccaataatttagttttccaaaatgaaaaattattgttgtcatctattttaggtgttttagttcaatgtggattcctcgtcctaacaaatacttgacgaatatatctagactataaaattggttatgagttctacttttttttgtttgtgaaattatcaaaatttgttatatttatttatttattctcattaatttgagtactaatttttaaattatttatactaaaaacaattactaagatacaaaaatggataagagcatggtgtatagatatttaatgggatagaatatttcccataattgtatgtgtgtgagaggttttgttttcgtaaggaaagaaacaaaaaccatttgaccaaagaaaagcaaaagaaggcaaggaatcaaacaacaaatgttgcaaggcagaaataatggacgttatgttaatgtagtgtcgtcacacgtgacttaaaagagacgagtctgcgtgtcaaactaaaaatgtatgcaactataaaaatgggatttgattatctttttagtaccgaagcctaccaaccacatgcacactaattctactcgccaaataaagtgaaaagag

SEQ ID NO: 240 - DNA, 3000 bp, Arabidopsis thaliana
agaaattttcttagtaaagaagaaaagatggctcgcggcataactggagcatttatgaactgttggtttatttggtttctattttgtaaggacatgttcctttcctgacatatgtcatcttctttacatgacgtgtgccttcttattttaccaacatgtgtcggtttcctcttcagatgttattttaggtcattccataatatcgagatgcgaccctgacagatatataattccaactggaactagtagtgatagatacaatttcagatataaacattttaattataaaacagactaaatattttaaagatttttaatgaacacttgttttaaaaaaaaaaaaaaattctctaggttatagtctttctttttgtcgattctataggttataatcaataattaccaaggataatttatattttattttcatccatattaaaattttatactattgtttaacccaacttgattctaaaaccagagttgaataacaacagcaaatgatgataagacgctgctctgattacacttcactccgacaagacaaaagtcacaaaaatccatttcgcccgccgacacatcgtcgatagaccgacatatcgtaaattaattcctaaaagatttttcttggtcaagcccaatgtagtagtatataaacattcttgcacaacgtacactcacagtccatacttacttagtgagtactccaaacataagaaacatgccaaacactagcagctctcaaagcttcactatcttcgttgatggttggttaatccgtcacaggtatttcgttgaacagcttatgtgtgcttcttccttggatgaaactaatcgtatctctctcgaagaacaacaatctctcgtggcccagtttctatctcactgtcttcaatactaccaagagaaattcgcctccgtttccctcgccggggacaacgttttcactttcttctgcccaccgtggtttaactcctacgctaaacttattttatgggtcggcgatttcaagccttctcttgtgtttaaactcaccgaggtctccgtggccgacctcacgcgccaccagaaagaccggatctcgagtcttaagtcggagactaggaggaaagagagagaagttatgcgagatttcgccctcgtgcaacaaagcgtggcggatccgccggtgatgctcgcggcgaggcgcgtgggagcggtgggaatggtggacggagaagaaacggatttggaggaggcgatggaggtgcttaaagctgggatggcggcagcgatgaacaacgctgatcagctacggtgttcgacggtggggaaagtggtggagattcttactccgccgcaagcgattaaagtgttgaggacaatcggacagcttcacctccgtctgagagacagagaccaagaaagagcttaaaaaaaaagatacttaatttgctttgctctgcttcttcaacaacgatggagtcatcactaatttttgtttttcgggctcaaccacttgatcctgagatttagatttccttttggtgatttatgatttttaaaagatttgagaattgggcttttttgtttgtagtgatatgatgtcatgttttttatttttggcttctcgtttcttccttaaatcagttcttactaaatctcatcagttacttttacaatcagaccaaaaaatgtcaaaagtacacagtacttgctttcaaaatcctacgtagcttatgatgtggtcgccatgtcatttatagtactttactaacttgctgacatgtaattgttgaaaaaatattacttttattccatttatcaacacaaaactgggcttaaagcattgggccaacaacagtgaacaacgggatacaaaaagagttcgtagttctgcaaatcgaatacaggaggtccaatatttcaaaagatgcatatttttcttggctaaattggtcaatgttattgttaggcatggcgttgactttagaggcttcctagagattgccagatgagggagtaaaagtcagctttgatgggctttttcatacgtgataagcctaagaatataaacaaacaatgctctaactgaagaatggattgaactatttttaatccaagtctagtttacatacacaaaggtattgtatgttgacatgttgtaatagattcgaattttccacaagtctatctacattgtggtttgagtcattattcatttattccttccaatttagtgaaacttaaatgattatctgaaaacaataaatgattatatatactaaaaaaaaaaaacatatcgctgctactaattttaaacaattacagaaagaaggaagaaaaagaacaattatgcaaacaaatgtcaactggttatatcatgtcgttgtttaaatattataactatattattctcaaaccaaggtattgaacaaacgttatgtcaatgcaatcaaattactcaaacgttaagcataataaacaaaacttgttttttcttttcttttcttttcttcttcttcacgtcatgaattgtgtcctaaatagaagttaagcctctcagatttttttcccggatgataatgtgtagtatttacacgtatagatttttcaattttattgtctcatacaaagattaagattataaaaaacttggcgttgaggaataaaaaataaaaacgtgttcaccacccgccgatttagataccgttttcacatacataattagaatttttccgtccaaattgtttttggtcaaagcctcaatggtcttgaattgacctgttcttaaaacccgacccggatccacctgcttctttcaactaacacacgctcctgatccaaaccattttttcatttttcaaatcattatcaactctctcgcttcttcaacgatcgcataaattccctctttgtctgctcgattcctgatctctagggtttgggttccggagacgaagggggtgtttcgtgtgtaattgagatattgagattattgctttgtaaaactcaaaatct

SEQ ID NO: 241 - DNA, 3000 bp, Arabidopsis thaliana
taatgtctaaatacacagcttttctcttcatcaataaggatctgtatcaataagagaactaagtgtccatgttacttgaacactaccctgtttatcttcctgccctctttatctttttcgtggcttgttgttcatcatgtctgagacttgggctacaagataagagactttagttttaagactaaaagtctaaaaccaaatccttttcatgttgtttcgtctgaacttcggtctttttttctctgtaattgacttagtcggttctcagatctctgagtcatgattgtaccgataaaccaaaattgaaccgattgtttttgtaaaaccaatcgggttctattaaagttcaaactaaactaaaaatttaactatggactgaaaataaataaaaaaattcttagacaaaaaaaagttggacataggccaaacactgtttgtttgacaaattctaagataaatgataaaaagatgagtttttttagggcgagaaagacggtttaaatccaaaaaaaaaattgggaatttatgtgtaccaaatgataaatatcatgaagacaatgaagaggatcaacataaacttatcaatctcagtcagatgcattatctgatgtctagtcacttctctatccaccttctttaatgtcatttagtaattttcacacaagcagaaacgtaccatgttataaatcttatcttctaatgtttacaaattcgtacgtcttacatttagttgttgacaaaaaaaaaagataattgaaatttagttcaatcatttttttcctgtgtgattgcgtttttcctttgacgacatgttgtttgtgattaattattgtgggttcataccaataattatgaaatacctagattattttttaaaatatagctcgatttaaatgtagtgtcattacaattcgacttatttgagtgaaaagagtgactgactgattgcttatcctttttaattattgaaggagataattattattacttttttgacgaaaattataaggttctcaaattttctcgggctatttttttcgtaattttcttttctatgattattattgtttagcaacatatagtagattctatttcaagagggagacagagcacgtggtgtccgccagaaacctatcgatcatgtacatgtggatctagttttcccacatcctccaattatacaagatcttgtcttttccaatttgttgatctaacgtatatgactgtaaattccattagacaaccttaaagagattagttagtaaagaaagatggtttcatatggcttttggattgtgtttgcgtttgttatcgtcgtttctaaaccgtgtttaggtacttagcgagatagatgtaaaaaaatataacaaactgcatagaatataatcgtatcgatcgttttcttcttgttccttatcgattgaatattcgttacgttcaatattttcatgagaacaaatatatgatcttaagtagagttaagaaagaaaataattaattcagattttactagttggtagttaccatccaatgcttcaattcccacatgcaactgatatgtggctacaagaggtttcacgtgttaaaataattgtttatttttgttcaaattggcgtttgttcatttcttttcaccattattggacaccgattcctgtgacacgattgtgattgagacaatgttttatatttaaacatttttttcatgtgcttgaccaaactaacaagtggttaaatgtatattcaattgcaaaactagttttcctaatgaacctagaattattgtttattacattcttagcccaaatgaatcacttatttgctagcttaattaggccaaaacagaagagatttgtagttcattactaaagtttaaactaagttcggtcatgttttttggagtctttctaaacaaattatattaattcaatgttattaaatcagtttaaattaagttggtcagatgacatactaatatcactattacacggaagtcaaaatgttagaaaactaaatatgaattagtttcgtgtaaaaacaggattagtttcgtattagagtcactaatcttttcatcttcaattctaatcagttaaaatggtcataaaaatggccacagtacaattcacacatgttcagtctatcgtttgggattgctgattgatttctttcactctcagatttttaaactattctccaaatcttgaagtgaaaaaagtagtacagaaatcaatcagcataatcataggattgtgttcaatgacctggtttcacagatgaaccattaaccatataaatttatttattaaattttattacatatttgtattcaatgcacaaaatgagaaatcatattaggaactacatctaccatgccaataaggaaatccaccaagtcaattttctaaaatttctgatgactgtatatatctatctacggatatgtataaaactacgtggacaattcaatgtaaaattcatatcattgtcatacccattcaaacaaacgaaagactaattaaccgataagaacaatataattgtattccttactaaattcttttactatattttccaatttttgagaaatttgttacccttcgtttcatgcataatcccattgtacagtataatggtaagaaaaaaaaagtagaaatataagaaaaccttttttctttcttttgaaaaacttaaatgatttttctaataacaccgcacaaatacaaatagaaaattacagatctaatttgtacaccaaaactcttttttactttggaaaaaaaaaaacttttttacttttgacatttatacccaattttctctcttccagcgaagcaggagacagtaaaaggaataataaatccaacaatttctctgagattcaactttaagaaaaaaaacaataatcgatattacaaatatatatataaagacatttgctctttctcgtgtcatcaaatctcaaaaagaaaaaaaaagagaaactcgaaaacgagaaaa

SEQ ID NO: 242 - DNA, 3000 bp, Arabidopsis thaliana
gtttacgagagactctctcttcttcttcaacctttcgatgtaaagatcaactcttttgccaaaaaccctaaaagtctgatcttttacctcgaagcgattctgagcagagccttcttcgaggatttcgaagctcctgggtttcagaaaaacgggtcgacccggattttgaatccaattgatcgttgtgaatccaattacgcttcgtttaacgtcttgatggagctgacgtgggatgaggtgttgagcagaggaacgaagcatttctcggaggagtttagccgtttctgtgaccggaagatgagtgacgtcgtttcgatgcttagctggaaccgtgcctggcctgaaccgcttttacaggtaagcaaatgttaaaccaaccaaacggttaataatggtttatttcaaaactacttggattgaaccggtttttatggcaggctttctttggtgcgtcaaagagtgtttggttggttcatcttttggctaattcagtgaacccggggttgcaaatctttcgtgtggagaaagatgaccggtttgatccgatttacatggaggaaaccggtggggaacggtttaagagtctggttagagctatggttcagcccgggttttatgtctatgggagtgtggttaagtgcaaggtggtttgcaagcaatgcggcagcgatgaggaagaactagaagaccatacggtcaaagaatgtaataaaaacgacaagagtttaataagcatttgtagcccattaggaggttaattacgttcatttaaggtttaaaatattggtgggtttttgtcttgtcttgtgaggttgtaattaaaaaaatcaatggcttttgcaagtgaatattttaaaactgtttaattaatgacttttgcaaagaaatatctaagaattagttgttgttgttgttgttgtcaaagtgattcatgaaagagtcgttctaaagtaaaatattggcattttctcgttggtttcgttatctttgatttgattacatttacgcgcgtattagtagtaacaaaatgggccgtttctcaggcccaatatatagaatttgctaatcaaaatccgagccttctctgaaaaagcccatttttgttcgttcttccttgtttcttcgattttccgtgactgattctgttttgcgaaaaggattgaaacaacgatgtgtaagatacattgataatttcagctctggaaatagaggtgctgcttctactgagtaagtttttatagttttccagactaaaacccacataagtttgatatgaactgagaaagagattgtaatgaaaaaccttgaatgtttccagatgacccatgaactggaaaaaaaaaatccttttcgcaaaacagaattggcttctcaaaacacatttataggttcatagttagttcttatgttggatgttcatgtcaggtctgagaatttacctccttaagcacaggttgttcctttataaatgagctccatttcggcataatgaagtgaaccctttagttttgtttgtgtagactctaatgagaggagtcactgagactgataagctagcaaacggaatcttccatgtataaacagcttgggaagacattttctaggaagctaacttctcttttctgaatttgaattctttcatttgcagcttgtttgcttagcggatctcgagtttgattatatcaacccttacgactctgcgtcgagaataaactcagtggttttaccggagttcattgttcaaggagttctatgcgtattctacctcctaacaggacactggttcatgacactcttatgtctcccctatctctactacaatttccatctgtaagtccaactaatctcaatcttttgctccaatcaaatgttgtggtattgatatcctttcggtttctccgttgttcagttactcgaagcgacaacacttagtagatgtcaccgagatcttcaatttgctaaactgggagaagaagaaacggctgttcaagcttgcttacattgtccttaacctctttctcactatcttctggtaacgagaaaagatatttcgaatcccattattgcttaaccataagtagatcaagagagctaaaacactttctgtctgcaactttttttcgtaggatgatttattcggcgctggatgattacgaggactgactaatgaagaagacatggtccatcttcttcggtttattgacactacgcttaaagatacagcgacatgctcgtggacatgaaaaaaagcaaggaaaagtgtttgctttgtgatgtttgtaagattagtggcaggaagatttgtgtatttatttatttcttagaaacatgttcagattaactgttttttttttatcttatgtcttgatcattatttgtacaagcaatcaagctcgtaaactactggttacagtaacaatgaaactgaatattttcaaatataagaagaaaaaaagttaattcatgtgaactttgacttttaaaagtgggaaaccctttagagtgatgtaataaacgagaacttaaaagatgattcgaaccttctgtttcagtttggtaattaggttatcttataaagctaatccttctctcacactgacaatcgtcgttatcaaggtgatttctttctctgcgtcaaacatcgcttaccctcttgattgattcctccaatcttcttcgtgtggtttcacaggtgtgtggttgatctctagacccaattgatgtggttccatcctatttttatttggtctgtaatcgtaaagtctttaagatttgggaatcgagtttatgttgtggtgtttaggtagcgaaaccccagttattaaatcgttgcatctagtaatttggggtcctttaattgaaacaaaggattaatctttcattcatctttgttcgttcattagcgaaatccgagccttctctgaaaaagcccatttttgttcgttcttccttgtttcttcgattttccgtgactgattctgttttgcgaaaaggattgaa

SEQ ID NO: 243 - DNA, 3000 bp, Arabidopsis thaliana
atctactcaatcgttagagtctaggatttgcaaaattttggtgtcgattttatagctgtgattcaaatcaaatctaggaaacttgaattcgactctgtatctgctcaatttcttatgtagaaatgtcgataagttctcaaattaggcgatatgtgttttgatttgattactgcgaaatttgaatgatgagtctaatgtttagtagattcatgttactgagaatctgcgattggattaatttacgataatctctgacaggaaatgttgctggtgtttgtataatgagcaatgcatggaaagttgaacaagaaccttcactgatcaatttcatatctgcgtttcttagcgcaaactctttccgccttaactttgtctctatcccccctgtatgtgccttctttctctgtttagattcttttggagaattggattatctaaaatttagcttaaagaattcactttatgctgtgataggatctcatcttcaattgtggaggtgtttctattgcttttgtttttgtgactaaatgggatttttccaatgttgcttccatcttcagcaggtctatataataaagtttcaagctctctctctatcgcaaactcctatatgtcttctgatttctttgacttaaacttttttagagtaaagaggctgaaagggcaatttgcgcaactttatgttgttgctacactttcaactaaagagcagagtgattcttttatgcgatcttacttccagtgagtggtcttctactcttcttttttcactttgcatcattttgcttatctgtgttgtcggaaatgaagctcgataaatctttttcgtagatatgagatggagtttgggaaacctgcgtttgtacaagtcactgatgctgagatgggatttgagaagattgttaagattgctcactctcgtggaggtataagattcatttgttttgtgttagttaatatactctacggtttttttagtgattgactgataagatttgaaacttgagcttcagtgtgcaagcaacagaaggtggcctctaagctcaaggttgaggtaggttctcatttgttataatgatctgtctcaacatttgtttttgacaatctctaaagcttctttcgttttctttcatgtgaagagaaagcgaactgtgcaggatacaaacatcttcatcagatttgtcacatccatacccaatattaacaaacatgatgcgaacacggtaatgtttacttatgagcaggttcaagtggtaaacttgcacttttgatactattaaaatacaattccaacttcaaacttcaaaccttattgtgaatcatgtcactgcaccatgaattctacttgcttgcttatgttctcatcggttacagctgtaccaggctattggttcaattgaagcaatcgctaaagcatccaaagaagacattttagcaaacacagatctctcttctaaaaaggctgatacactcaccaggtttttccaagatcctgagttctacctcagtcccaaattcaactgacgactgcagaaatagttgtaagatactaagatcacaattcttataaaatccgtaacgtcgtaagacttatctatcttattcttggccgtaacagtttctaaaggtaccactcaaagacttttcgtagtcctttgctatggctacaagactacaatacatacacctataggagccagtaccgggtaagtaaaatggctcacttttttatctttgctagctctgtctgaatactagtacttttattacatccgttcctgttaaagtgtttagcatctgaactttaatcaataaagatcggtaccaagactttttttgatgtttgcagtaacaccaaactgcatcgtgaaaacgtttggtagattgattgataagtttgagggttaagcacaataaatgaccacacttgtttttcttttggttgatagttacgggtttttgggtttctttgatcttaagcaaaaatgacaagctaacaaaacccatgtgaaatggctttgcatttataaattcttgtattcttacttatgttatccggatttaaaaatcatctacatcacacattatcttaagtaaaagattttacccgcaatttgtgacaaatcgaagaatttgccatttctacttgcaaattgatgcaaaattcatgttatgaatatatttcaaaatttatctacataaagacatattttgttataaaaaaaaacatacgaaacatatattccttctcaaaacaaaatcctattagctaactctagtaccaaaacatttcaacatttacccaaattggatacctaaataaagttgtagatacacgtcatcaatttgatcataacgttatcggtaggtctctgctgtctctgtcacaatcttaggtatcgttaaaagataaatattaagtggacaactttaacgaaaaaacacaaaaaagttgattggacaacgttactatccagtttttagcgtgttatccaacccatagaaaatttatctctctgtattcccataatcctcgtagattttggtcatcactagtcatttatttacaaaaataggttaaaaatgtcattgcgtaaaaaaaaaagaagacttaatcttacattatttcccttttaattattaaaatccgccgagaaaagtttcaccatcaatgcgtaactgaaaatcgacgaatcaaagctataatacacttaaacggatcatcatcatcatcatcgttgtcatgatcatcactgccgtatttatagaaaccaacaaaaacatgaaagagcccactcatttttcctatttttcgctttgcgtgccttcttatcaacttgtaaacaaagctacaaatatctttaaataaggacccaactctttttcaattcctcccatcaatcttcttcatttgttcttctgttggtggtggtgatctagttttcaaagaatcgattttgccaagtgggttcttcttgataacctttcttcttctttgaa

SEQ ID NO: 244 - DNA, 3000 bp, Arabidopsis thaliana
tgaaaccaaactaacagcatttttggggtatataagtaacagagaggttgttgtgcaggtcggtttatatcgtgtacacaatgctaggggatgttagcatcttccttgttggcaaagacgagtatgatgaacttgcttgtaagcctaacctactatttctaaaataactgatctctgtttcattcagagtttgattctttgttgtgttttttctcgtggtgcagtggcagaaaccatctatatcataacagcggctgtgaaagacgtatgtggaaagccgcctacagagcgagtgtttttggataaatatggaaggatttgcttgtgccttgatgaaatcgtttggaacggacttctggagaacaccgacaaagacaggatcaagcgactcatcagattgaaacctccttctgaagtttgatatgctccaaccaaccacacattcttcttctactcattttaagagctttctcattctccaccgattgttgtttgttgaatcacttctctatatcacatattcaactatcaactactgctgttgttcgatcagtccatcttgtagtgttgttttttaaatcttcagtttttagtgttacataacaaagaacaaatttctatccaaaggcttttccctgcggtctaactttggtgagttgttcaaagacctcaaaaattgattcgtgttcttatggcagtatgccagtatatcaactcaatatccagagactttccttttaccgtggaaaagaagaccaggtaatcccgccatggttgcttgctggtagagattaagatgaagatgaaggttgaactctctcgaacaaatagttatacaatagaagatagaatgtgtcttgaaattttgaagtggaacctcctgcatagcttgtgtgtctacaaaataagcactttccatttgtttgttaaacgcactggagctgtctgcgtctggactatgttaatgttagttgaaacaaaactatttaaatcaaatttgcaaatgagggaaagaaggttaaaaagctttatcaaatcttgagtttgatcatcggcccttcgacaggagaaaaggctagctatagatacaaaagtaatactaagcataaactaaagagtaaatttaaaacgtgctggtgggtgtatagtcgaagtaagtgaccaatctacactcactgaaaattttaatatcaaaatttaaagctaattcagcatattataaaattatggagtgcgaaactataaaatgaaatcataaaagatcatgcgagattaggtggaacttagcaatcatcctaaattacaaaaactcgatcaatgtgagttgatgtatactgtcatacgactaatagattataaaaagaaaaaagacctaaagcatttttattggaagtctcgtaacaatgtaaaaaaataatcatacaactaatttattagaattccataaaagagtttttagtttgagatatccataaaaaaaattatcttcttaattaaaacactgatatatatatgtactctttttaagtgttttctatttattatttttacaaattataaagtaaaatgatatgaatatcagttaaagagtttatatgtttttttttttggtttcattttaaatcataatataaattatctatttattaacctccattatgcataactctaaagatatattagaattattttaattagtattaattaaggtaactacaaaatatttgatatgtttagaacaaattaatacaatgaatatttttaagatgtaatttgatgaaaattaataaaatattaatataatattaatgaaaattttaagattaaataatattaaaatagtagtatcttaattaaggagatactatggatatcacaccaataggcatgctctaacatatttttttccttttcggaggattctttttatatatatatataaacaaataattaaatagcatcccaatatatacataaacaaagtttaaatcgttttagctatgcctgatttttttataactttttaagaattagataaataataaagcaacatgtctaaatactattctaaaaatatatcaattgttaattgggacagcccaatttgcactggacacggcaacaaatgaccaaattctatacacaaaaacaacaaacgagtaacgtttaaaaatgctgacgtgtcccaatatgatcttacctttgatatcgtttttaaggaaaagttgtgattgtctgagtcagcttgtatgagttcctacgtgttgaactaatcctgacactacctgagggaggtaatcacaacatttttcatatataaccgccccaatttcactgatttcaccttttccttttaccaatcacatcatcccaattatttacgtacttagcttgactagttgtcgttcattacaaccatcttaggtttcttataatcattcctgttacgtagtaaagaactattttacgtaatagataagattagatatcagttgaaattattgactatatagacatcctaattttatttccattgttaaatttgttaatatatctaactatcaaaacctaaatcgacgtgtcacactcaaacttataaagactaaacctattacaagaaataagatcttataggccgaatttgtttggtacgttgatgatccaaatataaataatagtttttctttttctttttaattatgaaaggttaaaaattcataaaaaaaattacccatatttgcttaagacgctagcttttctataaatacagcatagccatgtgtaattgatcatcagataagttccgtggttatcccattaaccttctttctacacaacacaaaactatatataaagatcatacatgtaataacgtcctgcaactattacaatcattctcgcttgaattaacgtggacgtcattgtttttggattgttaatcaaaggcggcgttacttttttttaatataattgtttctttaggatctttgtctctggaaa

SEQ ID NO: 245 - DNA, 3000 bp, Arabidopsis thaliana
ggcaagcatagactaattaattcttaaataacctaaggtttataagagatgtacaaaaacataaaaagaacttacaaaatatagaggttggtttgatgtaacgtaagataataagtagaatctagttaaagaagaaatacatacctcctcgcctagacatcaggttagtatgcagagttttgacgtatagtctcatccgtattcagtagagattcggcagaactttgtatttcccattcttggggtgtctttagacaatccttacaagcagaacattgaatattattatgctgccccagccacaacaaactaactttaaatataagcaaatataagtcctattaaagaacctttatgctccatcaatttgcagagtattgaatatcatatctccattagtttgcagaatattgaattgtatcgtttaagtagagagaattgaatttctcgggacatcatagtccaagccttcatataggctgatcttagcagatattttgaattttctatcaagttgttccagcacagcaagacaatagtagaactatagagattgatttctctaatcttttacttacgggcatagatcgacaagcatatgctctagcttatatttggcaacatcagcctatgatttcccagctacaacattatatctttcatcagacttattcaaggacttttcttatccatcagtttgcagaatattgaattgtatcgtttaagtagagaattgaatttctcagaacatcattgttcaagccttaatacaggctgcaaaattttgaagttcgaattttgaagttcatatcaagctgtcccagtccagcaaagacaatgaaccataaagatagtttttttttggatttattttgtattgtttaatttaaataatttttatttatctaatcattcactcatgcaataagaaattatttttagtattaaaatattttttttctaacaatattctcaatatttcattatacacataattcataaacaacgttcatcttaaactaatttaacagatggtagtgttcgattctagaaacctaagaatttgatgatggagctccgtacgtattctgcaccctcggtaatttattatataaatatcaatttaaaagaataacctatactcaaatcattaactaatccatgattattatatattcatactttgagtttggattacaaaaaaaaacattcgagtatgaaaaaatttattaaaatagttttattgaaaaatcatgtaatattaaaataaatttagtaatagttcattaaatatgtaaaataaaataatatataaaataaaataatatataaaataaaataataaatgtatcagtaacctataaattagaatttgaagagcttatattaattatttaataaacacatgacaaatgctaaaatgatgatgtggcaattatattgaggagacaattgaccaacttttgtatatatatatatactagataaggcccgcctatttaggcgggtataagatacaaaaataaatttttatcgatagtatttgaatattgtatagcaatctatatatttttttgatatttaatttaataattattggtttaaacaaaatttcagtcttatgcattctattttaattatatacactcaatcttatcaatgatatttgaattctaaaaagtaaccgaccattattctatatttaatttagtatctagaaaagaaaaagaaaaaataaatttctatcttacaccattcaattttgtaatacagtttaactatctatgtcatcataataaactcgatttaaattctacacacttcatattgagtgataacattttcatatcaaaataatatttatgacatatcaaatctatatcctagttagtattaaaaataatttacaattaacaaaacataattaataggcttaggcataatacccaaatccgaagaaccgatccaaaaaacccgatccgaacccgaacccaaaattttcaaatacccgaacatgtctaaacttcaaaacccgaaaaacccaaacccaaacccgaataggtatccaaacatatctcaaatataagtatatattagttatatttatacttatatatagaaaatattaggattttttggatattttagatatttttgtgtattttaaaatatattcaagcaaaactactcgtgttgttttgggaatttttaaaattttcaagtaatttaatagatttgcagacaaaatttgatatttcaatatataaataaactcgaacccgaaccgaacccgacccgaaatcttaaattacccgaacgggttctaaacttctaagcccgaaaacccgaacccgaaatacccgacccgaatacccaaacgcttaggactaataattaataaaaaaatagaaatctacaaaaatatttagaaaccaaacattgttgaaaatatattttttatatatgccgtaatctcgtaagttaattttacatcatacaaattaatattaaatgagttaaaattaataaattaaaatattcttactaaaagttattgaaaagttaaatcctataagctaagttatttctctcaaaatgttctattttcacttatgattacattagttaaagacaaatttgttaattttccttttgttgaataaatgttaaacatcttatcgtttgatttgacacgtgacacgatcttaagagttagtaacttgtaaacatctgatcgtttgacttgacacgtggcacgatcttaagagttagtaactttaaaaaccatactttatataataagatatatatatgattttaatattattttattagaatttccttttctggttttctaatgtaaaaatggaaatataattatacttacgtggaaaacgaaaattgtattttattttaaaaaagccgggaacgaccatctttctttcgtcggcgatttttcagagattaccagagagacagcgagaaacatttctttcggcg

SEQ ID NO: 246 - DNA, 3000 bp, Arabidopsis thaliana
gtcataaattttaaatttagatgattaatgacacatgatgtgtgtagatatcaatgccccgcggttgttttgacaaaaccttgatacgcgataatcttacaagcccacgttgaaagtggaccaagtgatcaattatttgtgaaaacacgaatcaaaagtcttagtactagttaattatacatttaaattatgttgaatatctgtttgactttgttcattctacttttagtttaatttcatggaccagtttaacgtgctgttaattggaaaagaagctgggaaccagttaaagcactaaatttcgagttaccaacttaaaccaattattcatttaatcgtttgcagatgagagtgtcttgggctttcaaactatactactctaaaaccatcgagctagagctgtcaaagcgggttgtccatgtccattagcccagtccaataatgtccatttcgatatttgacaaatagtgttcatgtccattaaagcccatgtccattaatgtccatgcccattaatgcccatgtccaaatgggttgtccaatgggcataacagaaccaaattttaacacaatagtatttgctttatattccaatcaaattatcaaatcgagaagcaaatttaaataacaaagtattagttgatttaaatatcaaatccaaaagcaaatttaaacacaattcaagtattcaacaaagtatcaaatccaaaaacaaattaacagcaaatttaaacttcttcctcttctccctcgccatctttgtcttcattaaggaactcgatattatcacctaagtacaacagtgacagaaacccattattgagtaatcaaaaacagaaacccaaatcgaattgagtaaaaaggatgagaatttgcttacttgaatagattaggattctcaggaggatccatgatgtgatggagatgagttgttgaaggaactcgccggagaaatcgccggagagaagaaatcgccgaataagcgccggagaaatgtttcccgacaaaaccaagaaatgttttttgcccaaatctatttttgcccaaatcgacttaaacctaatatttttgaccattgggccgcccatgtccattacgtccagtccgctaatgtccatgtccgttaacgcccatatccattaatgtccacttcataatgggcttgtccatgcccggtccattaagcgttggacacgggcagcccacgggccgcccgtccattttgacagctatacatcgagcttttggattggagaccttaatcattatatttgaattcatatatatttttcgctaacctgttaaactaatcacatttggtgtccacacttatattttgaccctatgttactatatatatatatatatatatatatatgcatgtgcaattccattgtaaataaccaaatcgatataataaggaatgaacctcggtatgagcttgagtcttgatgttaggaagtgacgatagtctatagtgacctgttttgttatgcggttagaagagattgtggttcaaaatggtcagaatcttttggtaagattaattaagaagttgtagcattttcataaataataaagggtttatttgtataccataatactattttaagcatcaagtacatttatgtcacatctatttccggttagtttaattttattaatttcgtctgtaaaactattcataactaccaaaccccattttcttatttttttctcaaaagaactaccaacagatcttcaacggtcttgttgtcgaattatttatttactttctcggggcctttgttactttataattagaaaaaggcgatggtcaacattctccggttaacccccataatgcaaaatcttattttgggcaaatgagagggtaaaatagtcatttaaagaattccgaccggagtttctcctttgattcctcgcccctatactacgcgtcgtgtcagactcgtaactccgtttgactcaattaccccacatttttcattccatcatttcctttttcattgttttcattgtttttggctagttaacatagccaaactatgttcattatgcaactcacgaaacttaatacaaagatgaatctaataactctggttaacgaagtatattctccgttgacaaaaaaaaaaaaaaacacaaacagagaaaagtgaaatctgttgtattaagaactttgtagctcctacaagccttttcatatattgaaaattcacatatttagcaaaagaaaaaaaagaaaattgaaaaatcattcccgttttcatgtactaaaaagttttaacagtaaatatgcatatatttaggaaatgtatagttgccttgataaattggtaagtttgatttaatatgcatttaaatataaaactctttttacatatacttaatcttcaactatcattctaaagtcatacccttttaacactttatttatcctctcttttttttttttggacaactaactttattttatccaatcagcttttaaaatcttaattaacatggtttggattggacaagctaagtaataatactataatacgccacgtatatatacgacgtatccttcttctcttcacgtataaaataaaaatagtgtgttattgccataacatacgtgttttctaaaatttaaaagaaagtcatttatcatgaaaaggtatcataatcagaataagagtaatcagtttgaaaactagctagttgactaaaacagaaagaaaaatatctttacttgaaacatgtgttgagaattcacattatataaaaggaaaaaaaataaaacatgacttttgcgtagacaatccatagtccaatcaacaaaacgtgtggacggcaagggttccttctagctctctctatttatatctctcactcgccgatttttactagtaattaaccagaacgttcatctaccaacaaatcctcaactccttcttcttcactaatagtataccacaaaacctcaaaattgtaatttattagattatcgtg

SEQ ID NO: 247 - DNA, 3000 bp, Arabidopsis thaliana
aaaaaaaaataaaaaattattatgtagatccatcgaacaaaaggcttgaatatacggaagtcacttaaaagtgtaataatcgaataaatattagtggataaaatgaaatttatctacaaccctactctccgacatgttactgtttgcgtcatcaaatctaaagcctttttggcaaataatggtcggaagactactcgtgtcgggatggaccacccggatccgatcaggaaacgggttttgatatgtttcgggttacgacaaaaaattagggctttttatcaaatcaatcagttggtagtaaaattttgtggattgttcttgtcgattccgtttgattgttgaccaaatttcttcctggattttgttgataatcgatcgtataatggtgattgcagtatcgtccttcaagcgcgtacaacgccccattctacaccacaaacggtggtgctccagtctccaacaacatctcttccctcaccatcggagaaagaggtatcgtaaccctgaatttcaagagtctatcaataagaatcggaacttgttggatttatgaaagagataaaactgagatatagagtctaagctgagatcttgttcgtgaagcgtgatgtgattatttttaacatgtgttacttcgtaatgggcaggtccggttcttcttgaggattatcatttgatcgagaaggttgctaatttcaccagagagaggatccctgagagagtggttcatgctagaggaatcagtgctaagggtttctttgaagtcacccatgacatttcaaacctcacttgtgctgattttctcagagcccctggtgttcaaactccggttattgtccgtttctccaccgttgtccacgaacgtgccagtcctgaaaccatgagggatattcgtggttttgctgtcaagttttacaccagagaggtataagaaaagattcaaagtttccatttttaatcgtcttttagcttctttagaatcaggactgatttttgtcttgttactgttatgatcagggaaactttgatcttgttgggaacaacactccggtgttcttcatccgtgatgggattcagttcccggatgttgtccacgcgttgaaacctaacccgaaaacaaacatccaagagtactggaggattctggactacatgtcccacttgcctgagagtttgctcacatggtgctggatgtttgatgatgttggtattccacaagattacaggcacatggagggtttcggtgtccacacctacactcttattgccaaatctggaaaagttctctttgtgaagttccactggaaaccaacttgtgggatcaagaatctgactgatgaagaggccaaggttgttggaggagccaatcacagccacgccactaaggatctccacgatgccattgcatctggcaactaccccgagtggaaacttttcatccagaccatggatcctgcagatgaggataagtttgactttgacccacttgatgtgaccaagatctggcctgaggatattttgcctctgcaaccggttggtcgcttggttctgaacaggaccattgacaatttcttcaatgaaactgagcagcttgcgttcaacccgggtcttgtggttcctggaatctactactcagacgacaagctgctccagtgtaggatctttgcttatggtgacactcagagacatcgccttggaccgaattatttgcagcttccagtcaatgctcccaaatgtgctcaccacaacaatcaccatgaaggttttatgaacttcatgcacagagatgaggaggtacgtcttagtacaccacttgagctaccattgttagtctttttacttggaatcaaaattctcatttggtttgtactttttacagatcaattactacccctcaaagtttgatcctgtccgctgcgctgagaaagttcccacccctacaaactcctacactggaattcgaacaaaggtccgattcctgccatgccttctctaaatcttcaaatcctaaactcaagtttattagaatattggtgctaagaaaaccttttaattgctaatgttgcagtgcgtcatcaagaaagagaacaacttcaaacaggctggagacaggtacagatcatgggcaccagacaggcaagacaggtttgttaagagatgggtggagattctatcggagccacgtctcacccacgagatccgcggcatctggatctcttactggtctcaggtcagaacaaaaaaacactcggtcaaatttctacgtcctttttaccaagtttcagcaaactaaaacattatttatctctctgtatctctcaggctgatcgatccttgggacagaaacttgcaagccgtctgaacgtgaggccaagcatctagaggccaatctccatataagctcagtctatgtgaggtacaatcaatctcatcgatctatcatcgcttggtcgttaaatccgtcaaaaagataatcacatgtgttgttgtttcttgtctatataataataatgcttgtaatcccaaaaactcatgtttccttcctttctactctcactgtctttgtaatctctttttacaataaatcaatgtttcttgaagcagtaaacaatttctaagatttatggtggtcgttatacatattattaattcaggaaaaaaaagagaagataccgtaattgaacatgtattattttaaggagaatcctgaaatggatcaacaattgtctaattatggtatagtatctggcgaaatcaaagacgatatcatccacacgtaattagtttgactattaatacgaggattatcatttggataaggattaacaaagacaaaacacatacgtgttttggtgttgagctaaaataagatattttggctctcgctataaaaaaaaaatcgacaacagtgcagacacacgccgatttgcgagatacacacagtctcacctaaaaatcgcaaaagaagaaaaattcggatcaaaattgtcttcaagcatc

SEQ ID NO: 248 - DNA, 3000 bp, Arabidopsis thaliana
tccgaagctctacgcttctcatcttcgtctcccttctgcaaatgatgaactctcttctcatcatcgtttctcatatcatcatcgtctctcgatccgtcacgatccccatcaagttttatcacgtcttcatcaccggtagatcaagcggaatcggtgaaattagatacgtttcatgagcttgcggcgaatgagatgatgcgttgtgcagagcacggtggagaacggtgcggaggcagtgagcaagccggaaaataaaaaatgggggcagaaggttggatacgtgcgagatacttcggagaacttgcgacaacaaatggtaatgtgtctctatacttctatttgagacagaatataagggaaacaagcaagattgatgtgtgatatctttagaagtggactcaaatggttagagctgtaggcttggtatcatgatggttgtcgtatttttggctggtttagataataggaatgaagctagattgcctttggttggggtgtttgtggctacaagtttttggtttttgttgagcgcacacaaggtgtttgataaaatgtcaaagagaaaaacagattggatagatgcaaaattgttgttggctaaagaatgagtaacagatagcaagtaggatttaagtttaactttgccttctatgtgagagctttgtgttgtgtaattgtcatgtttgtgtgtctaggtgtgatggatgtatgggttctttcctctccttagctgcgtatgatggctgcagcaataccagcaacaacccctgagaaagatttcaattccttacaaagttatgtatgcatgtcacaattcaggccaaacacaaaaaattctgtacaaggacaagcaacgcaagagaatccaaaatccgatgaaggagatattaaaacaattggaaatttgtgattcgaggttcctgtgcgtgtcaaattagctatgttcttgtaattgtcattttttgtttttttttaagaaacccacttaagattctaccattgggaaataagattgaataaaaactctaaacttccatttattcaaaatataataatataaaattttaaggaatccttaattaaggtgtttcaatgggggtgctcttaagagcatcctcaatgggaggatttaagaggtttcttaggttaataaagggatttaaattaaatgtttaatgatgattttagcttagaggccctcttaccttagaggctctcttagaataggtgtggaggtgacgtggcattattctcgtgtttcttcttcctcctcctctctctctattccgcgatcgaagtgaaatcggaacaaataattctcttgtccggagtttctataatcctttcaattcctctacttataattcaattttctctcgttaatgtatctgatgcttttgtatacacaggttccattcgataaaatagtttttttttccaggtaagtttcatgatgattatgtgttctctcttttatatttcaattgtaggatatatgtaattgttttgtgtcatgggattgatttgtgttaatgcgtttaggaacattcatgggattgatttgtgtcatgtagagagattgagtttgcctaaattagctcatgacttttttggtgcatgtactctttacattacatagttctctaacttctgtctgtgatgaaacgaatgaatccgatcattcttctgtctttagtttaacgaaagagatacaaaatatagtgatgtaaccactatgttaatagctattttgtcttatatttttatctaagctcatgcagcttaatcttatatggtgatgacaaatttaacaattggagacaaagttgtactttatttccagccatgtggataacctcccattgaggatggtctaacatcctcgtgtttcatactaatcttttttttgttatatttagcttatccaattcgcttgttctttatcatccgttcaaccatttataccgtatacgactagtactccaccaatttatttcataattgcaaatgaaaactcgagtcaaacccaagtccaaaagggcaattcgaacttggttattgtatccaaattttgaagtcaaagccatgcatcaacttggttacagactgtatccaaattttgtttgtcacggaacgtatctttcttctttgtcacggtgtatttaggcgtgggttttgcactttttgtggttttctttctttggtgaagttcctttaatttgacatatggaatagtggaaaaaaaataaaaggacaaaaacacttaaatttcccgaacaaggacaaaaccttaatagttccaaaattattaaatttcacagaaagttagaaacaaccaaaggtatccgtagaggttaactttaaaggaaaataaagcaagtggtccactcccacgtcgatagtcaacttattgctcttttcgacataatttacctccttattaaatctccttggactagtataactttctaagtatgcttatatctttcatttaaaggcgaaaatttgaaatctgttaattaagcagacactaaattccagattaattattcggcacaagacaagcaaaatagataggcacatgtgccttggaagatgaagatatacttggaacgtgatcatgatctggtgccacggaaacctatatattttgttgcacgtatccctaaatgattaggtccattcggcatatctggcattgtagattttctgcagtacgctcaacttgtagatgaacattatcttatattaggtttttatgaattttacacataaatggaaatcccgggctcatggcaggttttggatactattcacacgtgacgtaatttgtggacaaccaccaaggccaagaagttattagtttggtctcttttttcttctcttctttcttctcttctttctctataaaatggcttatttcaaaggcaaaccaaaactcacatttgttcattacaaaaagaggaaactgacaactgatttcgcgcaagagaaagaaaa

SEQ ID NO: 249 - DNA, 3000 bp, Arabidopsis thaliana
atgagcaagtttcagttgcttaatggcccatatgagttggttttggttttcaacttttgcatcagtacttgtatcttcttaaattttcaaaatatagtaggctgattaaatctaagtttggagttggcaagtgtaacaattgttagttttacatataccttaccaatttacacatgattgggcacctaattcatgtgaacaagtctctaaacgattgcacacacacaaaaaaaaaagagtctcattgtttaaaattgcgtcgacgtaaatagaaaaggtttcatcatcccaccaaaaacaaaaagacacttatccattggggaaaacattctgaaccaagataagtcatgctgggtcccacttacatcgactcctctaagactgtgtctttgacacgtgtttagttatgattcgtttatttgcagccactgtgtagaccccacttacctccttttacaaaatcgacattcaatttacacgtgtcgctattccctggcttgtcccttaagctggacatgggaggaataagatactctttaatttttggatggctatggctaaatagatggctcagaagaaataagatggccataacttcattcgttatccaaagctaacattaattggttagtatcaaaatttctaaaattgtgaaatatttatagaatattagtatttaaaattatatctaattgtataaaaattttggggagtgattattagtgtcatgttacttattgtaactatcgttgtgcatatcaataaaaatatacggatttcaattttaaacctcacatttacagatatttagttagatatttaaaagggatatctgcaaaatggacaatatagatattcgattttttttatcgtagttaacaaatgcatgatatcatgtatcatatttacacatactattcttttttttttaagtctagtaaaacggataacgggttgaagaaggataaaaacatttgtatccagccaagccctaaattggtattgtcaagtggaagagcaagaaaagtaaagaagaagaaagtgtcaatctgattcggatccaattacccaatcctcgttggcttcctaaacaacgtgaaaacaaaacacggcttatatatgtcaacgttatttacattgacacttggaaccattaacaccaaatggggataatatcgtaaaataacacatggttagtactttagtgacaatcctaatgctgctttgtcccttggggggtttgagaggccaccctgacctacgtggtgcccttttaatatcaatacattcccgataatgtgtgcttacatgttttaattatcttagtttagtcatataataatgacttcgcttttaactatattatatttactatatgtaatatgtacatgcatgttgcattcccaatgatgtttgttccatttttatgtctttatctaagacttttagtaagacaagataactctaatgatctttcttttttgttaaagtaagaatatatatcgattcaattcatcttatcaatatggatatagtcttagatcgtgtgtagaagttttgttttttgaccaatacattaaattgttttagtctttttttttttttttttgccaacggattatgataattatttcttaaaacgttacctgcactttgtagagatgtgactagtcggtattttttttgttaacatgaaacgacttgtcgtcaacattagatttttgtatacatggacaccgccactttgatataaatttctcatgtcttaccaaatcatagattcaatatagctacttaaactatacattgaaatatttttaaaatacataaaaacaaaaactggaaccgtaaacaaaattgatgggatgtttttttatttgtttcacgggaaaagtttgtagaatttaagcatgctacatgcaatgttaaaaactgttgtatattgtaatttatttacaccattaacattttatattgtgtaaacttaatgatttggcaccagagttgagtttttcttagagtcatgtttacggaaaatctgattcattttggataaactcgtaaacgatagctcattataaaactaaccaaactatcattttattaaagtaataaaaaagttgaccagtaccaatatacgacctatacagagtaggtttgatgagatctcataatctcttaaattaaatacaaatttagcattacctttagattggattaaggattaaaattatttcatttgtttcagccgaaaaaagaaaatggtccaccacattatctagtcatcatctgatctactaccaaaccctacaataagaagataataagaggattgagggtaataatgtcatttacatacacctttatattattttattgccaaaattagaaaaatagatcgtaagaaaacgtgtatatgtgcatttggtattatgttattcggtttttatatttttcttgtctctcattaaattttcttctctatccaaactctgtatagcctgtccccaaagagtctcgagtccttatcgtgaacttttttgttcattcatctgttccacgaagaaaacaatttagatttctccgttgaagtttttcgccggcgatttagtgattctcggagaagaaggtgagtagcaatagtgtgatttttttcttttgggtttttgtggaaaagttttttattttcgtttcgttttgaactgtttcattcatgggtacagattgaatttgtgtgaaaacgtgttcttgagctgtttgttttcgggatctatatgtggcaagaatctcaattttgtgtttgatttggtctcgttgttttctgaatcatcttttggtgtggcattgtttgttttggtgatatagactcttgttgtaagatcattgtttcatcagttttaatgaaatgggtttgttttattttcaggtattttgacgcttgtaagtgtttagacgcgtgttggatttgtaaaaatccattctttggcttgattcttctct

SEQ ID NO: 250 - DNA, 3000 bp, Arabidopsis thaliana
ctgagatgagacaaccaccatatcgccccttcatagatgttccatcaactacaatgaccttgcgcataaatgcgtaccctttaattgatgctgcgaatgcgatgaattgatatttgaaacggcgtggaccagtaggatcatcatcatactctgtaaagcatagactgcctgggtttgcttgttgaaggagtccagcgtaagctggaataagtgcatagctaccggccatagatcccaaagacttctccattgccacctctcgagcccgccaagctttccaatatgatatactaacatgatagtcgtcaagtaggaacttcctaatcactgcagcgtttggaccacgtttaataccaagaaagcgagattgcataagctcgcctatcacttgagtggttgctaaccggtggtatctacgcctttgatcaatcgtgcatgtgtgtctctgatttgcctgccgaacttgaaagctgtcagaagtatcaaccttagatgcatatacacgccatggacaggtcttggaaatgcatttcagaaccataaacttaggagtagaacgcgcagttctgaagtgaaacttgcggttgatggcgtgtatagctatcttaatcttgcagtcagacttcgacttaaagactctgccaacaaacagcttatctccttcgtatttaacgtcaaagaaagcagagtccacacctgaaataaaaggaacatctatcagcgacatggttgtagtctgtaatataaatagtacacgattaatataaatagaatagtataaggtgtgaactctattttcccaattactccataaccaaatttgttttgcaacaagcatcaaacaaaatctatatgtagatatggaatgcaagttataccttcaccttttccatcgttaaatactggtggggcgtcccgaccaaaaagaatagggtcatcactgaaatcggataggatagtgtttaaagcttcttgtgcccgcccccaaaaaagaatgttttgacgctgaaggtcagtttctgctacagcattaccaataggagaaacatgattgccatgaggcgtgcccacagctgcccgtgaggaatctgcgccttcgatgtcagcattttccggaatggtgatagctggtggattgggtggcagtgtgaatggaacaatgagcaagtcatcatcactgtctgttgaggtatctgtcaccgttgctctgcttggaccagccttccctttcttcccaattgggtccattattcctttccctttgtcagtagggagacagtcagggcttttaaggcggatgcattcttcaggctctctaatactgattcctcctgtagggaacagctctcgcctggtacgacggtgttgttctgtctctgttgtagcagcggttggctctagtgtaggccccaacacggcactatcaagtgcaaattggtgaagttcctcctctgagtcataatctgaatcgtcactgtcctctgaattgaagttcttgtccgtaacagcaaccggagaacttggaatagtgtgttggacgacagttacacatagattgacctcctctatatgccgccgcatttgaatgaacattgtaacatcactatcttcgctgatgtattgaggtggagaaccgttgccttcatctatcgccatccactctggaaattggtatgccattttaactgtgatgcctcttccacgcaagccaagtttatctttcaccttctgagatagctcttcatacgtcatgttagttctgagtcggatgaatgacgatccttcgacagtcttaggttcaaactgccaggctagattatccaccctgacccactcgccaatcaccaacaatacttcatcttgtcctgcggtctacatggattatggaaatagttcagtattatttagaaagaacataatgaaaattaaatgtaaatatcaatcaataataacagttttccaatttaatcgttcgtagcttttaattacggaataacaaatacagcgtgaatcacgatctaatttaagtaaatactaacaagttgtttagcagatctacaatctaggtaagtggtatattcgaacgtaaaagtgagaatttttaaatggaaactttacactaggcaattaaatcacgagagactaaaaacagaaacaagaaagcgatggttttgtacctttcccttttgattccctgtatttactgctgtactattttcaccaccatccatactgttctgttttgcaggttagatctctgcgtaaaaggtatagcatttactggcaataaatagaaaacagagcatcttctgctccgatatttttggggggaatattttattcaaattaatgtaaaaatctgcaggttatgttactgatgggacaattctcaagcggtgctaggataatttttttactggcttcgaaaggagacacgtcagctggtagaaagaagctcgctcttaccctcacgcgcgtacaagaaatcacagaaacgtggcttagggagtgggttgtaacttcacatacccgtagcgtcactctctcaattccttcgtttatggtgttagttacttaatatttttatggaatatggttattgagctaattcacccatttttttatctcttttaatattcgtattctttttgtaacgttccaaatttttaatattatcctgtctgttatcaagcccataaaataagcccatggccttccacaaacccatactacaaatcattacggttcccaaagcagaagaatcaaaagattcacaaaggaaaaaaaaaaaataaccgacacgtgtcagtcactccttgacaactggataattcttagtggccctgtaaatctaaaaatttcgctgtcttcgtcactctccctaacttcctttttctggttctctctttcttctttctattttattcaaaagccaattcccaatttcccaccaaagcatcactttggcgcaatccgaagattctcgccgccgccgtcgtc

SEQ ID NO: 251 - DNA, 3000 bp, Arabidopsis thaliana
tcttaattgatggatttggagattattagagaggtgagttgcttctctgagtggtgtcttggagcttagataacggatctatcagatcctttgctactgtggttgttgatggacactctcgacggtatggttcttcccctcccagatcggatttgaacttttgtggcttagtctcgttgtctcattgttcttcttctatattacatgtttgtttgggagacttgtatcgatggtggtgactctgtttgtggattatatctttagatctttgctctacctctctattgtgtcctcttacttgttcggagttgcattttggactggtttcgttcttggtgttggccactttgatggtatttcgttgctgagctacctactagcctatcttgtttggagttaggttctaggcaaagcaatggattcgttctctagttcttctctgggggacgtcatcagctttttgtctgtaggtgtgcggaagctgcattcgacgagggcccgcgtgtaagaactagtgatcttaattggcttatctcttgtcgatctccaaggcttttgtcttgtccctagtgcatttgctatctcggtttggttggtgaggtgtgatggtgtttgtatttgtgtctctcgttctggtggcttcttgctttcctccctgtcggattgctactggtttgacttcggtgtgaaatctttccgatcttattggtgcttccgacgttcaccgtttctttggggaagctttgtgagagcttttggttcctttgcgcaattttagtgcttaaatcttcgttttttcttaacggttgattttttttagatatttgtttctttgttttcattgctggtctaaatagtttctccgtttctttggggcttagctaccctcttttaagcttaatttctcgagacattttgttggtctgccggcttttatatttgaaatggtatcctactttggtttcttaataaaattctggcgacaaaatttttttttttcgaaagatcttgtcataaatatttcctactgccttttgcaatacgttacaatgttgacaattagtaaaattcctcattttttccttaagaaaatatataataccaaatgatgatgattccacgtatagatgtctatctcattgcgatactatattaatataaatcaatttcttccaatttctgaccatcatattagtattatattgacttttatatttggtctgcattaattatatgttccccataaatagttagcaaatccggttcggatatgtaggtccaaagccttttgtatttttatccacgcaaatttttcttgaatcgtacgtaaatattgaattccacgtttccatatacaaaaccaaatcaaatataattacttttacaacaaccccatttacgatttgagaaacaaaaacgtaaataacttacgaattttcatgttcttgaatcttttcagcaggaaaatagtaaaataactcaatgtttttatggaataattaaaaaagaaatagagaaaactgtttaattttcaaattattccaaattttgttagaaaagaagttgaccttgaatatctagtttgattctctatttgagatagctatttatcccttttagtttttaggttcataaaaatgtacagttttgtactttgcacattatcaaaaatgtagaagaaaagtaaattattgatttgattggtgacttaaaattatataaatttgttttacagataaaaaaactataaacaataccaaaataattaaaaataatactaataaaaattagaaaataacgactttacatgatatttttggatatcagctttgaatggtaattcattatcaaaacactacagtttgtatatgtttgacaattatcattcacaaaatttttatcaaaaacattacaaaaatttttagtagaaaactttattatacaactttctctgcttatttttttacagttttacactatttttaaagctcttataattgtagttaacatcaaaaaaatttgtacaaatttgtattaccaatcggactcattatttttgcgattagtaataactaaagaggtattagtccgattcggatctaatattggacttaagacattggaacttgggacgacctcgaataaaccctaacaacttggagagataaatacatttagaggctgtcaattttctaaaaaattaatacaaaaatcatagtaaatatattattattaaatacctagtaaatgtactgtccacctaacacttcaaaaaaagtttggtgtatcggtcaaaaaaaaaaactgggcaaccgataaaacaagtttccaagaagaaaaacacaaacgccaaatcagcccaagtcacaaatccgtcgtcgtttagtccacgtagacttcacaaagtctacctttttcaccggttataaccggtaaactaaaattctcctctcttttaccagtcccgttgaaactccgttaaacttttccgtttctccgtcattataaatatcaatcttcttcactctatcgttttttttttttccttcttcttccctctcctataaatctctccgtcttctctcttctctcatttcacgtcggagatcattttctcctcctccgcctccgcctccaccgccaccgccaccgccgccgccgacgacttttctcacttactcaacaccagaggtctctctctcactgtttcttcttctcctttctttcgatttcgtttggtagatttttagatctgatttttttctggtctctgtagctttacttgaagttgactctgtttctcgttatagatcttgatctgtttatgatttcgaataagaacagcttcaagcataattttatattcgaataaaaattagatgcaatgtgtttatttcgcgtgttccaactacacgagttttttttttttttttggattaggagttataacaatctcattgatcttattgttttgattttagatcttggtttagtgttata

SEQ ID NO: 252 - DNA, 3000 bp, Arabidopsis thaliana
atttgtttgttttgttctactctgacacagttgtttaatccaatagtacataaaaaaaaaaacataaaaaaaaggtagccatgtgaaaaatccataaatgcccttattcatcgttttcttattccgaaaccgcttttgtaagtttcagttttgtaagaaaaccaaaaacaaaataaattattttttcttcttagaaggaacagagaaatggtttcggactcggacctcgtgacccagctccgggaaattctccgtagctccgacctagaaactacgactccggcgagcgttcgccgtcagctggaggtgtatttcggcgtcgaattaaccgataagaaagctttcgtcagggaacaaatcgatgcttttcttgaaagcgatgctttgttagaaagcaaacccgagcaagaagaagaagactgtaatggcgatcaaaacgatgaagagggaagtgaaaacgatgatgataagaccgaactgtaagcttatctcttccttttggaactgactgttttgttataattcaaattttggaactgactgtattcttggtgattttggaaaaatggtttctttatctggcaatggttagccaactaaagttatttgtttgatactttttgtgtatggatatagctatatattttaatggtgatcgaatcaatcaaaggttggggacttttagtttctttgggattgtttgtgtactgtttcttgtgattggctttagatgaaagaagtcaaatttgtgattatgttgtgtttttgtatgtaacagaccggtaaaggctaagaaacgtggaggtgggtttaacaaaatatgtcagctttcaccacaactagagaagtttttaggaacttctcaattggctcgaacagaggtagtgtttttcatttctttgtaattttgttttccctttgatagttttgtgtggagaaatgcttatgatgacatttgcatatataacaggttgtgaagaaaatgtgggcgtatatccgagagcacgatttgcaagatccaacgaataggcggaatatattatgcgacgagtcgcttcattcgttatttcgtgtaaagacaattaatatgtttcaaatgaacaaggcattggcaaagcatatttgggcgctaaatgatggagatggtatgttccttgttaattttactagatttaggtggtggcatctcgatgagtttaaggtgtttatagttcttgtgaatggtttatctttatagggtgttttaagaatgtgaaagaggaagatgttgatgagacatcaggggaaagagacgagaaagatgtaaaaatcgaagaagcgttagagaataacgaagaagagagtagagaagaagaagatcgtagtgtccgaaaacgcaaacgcaagaaaagaaagttagttgtttctttctcttaatttcgtgtgttttgtatggttatatactaaaggtcaagagaaactaagccctgtctaacgaattagaccagccaagtccgaggagaaaccgaagaaaaaaggaggtggttttaccaaagtttgcagtctttcaccagaacttcaggcttttactggaacgcctcagttagctagaacagaggtacacataactgacatttagtgaatatattacaaaacttctagatgtgttatattatatgcttaaatgcttaatgaatggtttttaggttgtgaaaatgctttggaaatacataaaggagaacaatttgcaagatccatctgataaacgcacaataatatgcgacgaatcattgcggtctctgttccctgtggagtctatcaatatgtttcaaatgaacaaacaactagccaaacacatttggcctctagtacaggaggatgaaggtatttgatgattgaaaggtgttatcatttttcctgaagtattcatctctatctttttttatgagtacattaatttttgtactgtctttttttttccagcaggaacaactaatgatccagagaagggaaagcagaaaatgaaaatggagacagacgaaggtacagacatacatttttttaatctattcatgttacttagtcaaggtgaatataaaatcatccaccttcttaaactatatagataatgatgaatcaaatgaagaaaaggctacttcatcaagaatcaaaactgaagaatgattcgagtgagaagctgaaactgaagaactctttgaagttgttctttttcctgaggcgactcaggaatcggtctcaaagctttctaactaaccacttcatcaagactgaacaatgattctgtcattcgaaggggccaattttggtaagtatttcatatactcgagagtcgagccccagatttaactgatgtttaagtaagcattttgttcactcttggtatagaactatatatagtgacaaaactggacctgaccacagctagtttgaacttttgactaatcagactttaaacttaatgcactgtagaaaaagtgatgtgacaatatgtttcaactttgctaacaaaatttgcctaaatagttgctaaaacgtttcaacttatctaccaaaatttcagaaatagcacaatgatgctaatagagaaacagaaggtggtcatgataggtggttttttatgtgttttttcactcagcacttgaataattgaattcaaaaacactctgactcagttatctttacaacaagaagttaaccttcctctgtctttacaatcttacacagtagagtttggtcatgatcttaaaacgcctcaatgtattggtgtttacgcaaaacatcaacaaaatttgtatcttccgtaaatcttctgagattcatgcatatatttcattaaatctgtcttgaggaccaagtatggaacttaaaatggtttaacaagcatatttcctttttttattttgtattagaggctaatgaagaaactttacattattttggtgctactattagatataaacacaactcaataaagtttacttgcgctgtaacataatcatc

SEQ ID NO: 253 - DNA, 3000 bp, Arabidopsis thaliana
ggtaagggggacgtttttaagacaagtttttccaccaaagacacatggaatcaggttcgtaaaaaatcaaacgaggtggcttggtataaaggggtatggttcagtcactctactccgaaatatcagttctgtacttggcttgctttgcgtaataggttatcaacgggatatcgaatgcagctttggaataatggctccgatgtgaagtgtacattctgctccacatctattgaaacacgagaccacttgttcttctcgtgtagttatgcctcagcgatctggactgcaattgcaaagaatgttttacaacatcgattctcaacagattggcagacaatagtgaattacatctcagagactcaaactgatcgaattcggagctttttgtcacgatatatcttccaactcacagtacacacggtttggaaggagagaaatgatcgacgccatggtgaggagcctagaacgtcagccaatctcattagttggatggacaaacagattcgcaatcaactctccatcataatctcgacaggagaccgccgctacgagaacggattacaagtctggttctcgacaaggctctagactctctctgctctttctgttaagctctcagattgtaatttcttatcaaaacaactatttcaactcacataagattaagctgatgtaaaaagttatttttctttttgaatataatttgacattttcttcaaaaaaataaataaagtatgcatttatggtttacttgcaaaaattggggaatggaaaaacaagaaatggaacgggacgggatagaacatgtacatatgtgctttcagagatatgtcttaaaacttattttgacggaggaagaagaagagtgatagtttggtcgatggtggtgatggtgtcttgcgatcaaagtcgcgaatctaagacacatatttggtgtgccaagatttcgtttaagagacaagaaggtgtaggagagctttggaaatatatgttgaatggtctaagattgtgttacactttcgcagatgtaacgttcctagttcctatttccttttgaattctattattgttacttattgatcatgagattttaatattttattttagtttttgagaggatctagaatttttgaggtataactttttgggtataaccttaagagatgattgattacatccagcttggacaaaagtggctaattgattatatcattccactaaaatgatgatactccggaatgtagactctcaaagcaatcaatgagttgagcttaaggcgcatatcgttccattgattgtaagtcttatttagattcttctaagcttttttttttttttcttttcttttatgttaaattgtgcgaatttcagatcttttgaccttatatattttttagtgtctggaatcaattttgagttcattactatttaataaatgtctttccgtcctaaaagaaggtttgaatccggagcgcaaaggaatcaaccacttgagctacaactaggttaccaacccattttggtaggtttgttgctattaaatacgagagttctcgttctagttccagatacagatatgggcatcatgccatctttaatcatttattttgtgttttgaaatgcattaccgtatacagggccggtcctagcctaaaactggtaaaggctttgctttaggcgccaaaaaatatatgtagtacaaagggcatcaatttctgaaaacattttatagtgtagtggttagctctaaatgtagataattgtttttatggtgcatagtttaaatctcaattttgttattttgtgacttttctaaatgtatgaacttaaaaatgctttagacactcaaatctcttggggcggctcttaccacatgagatggaaatttaagattaagagtgaaaatttgtataaaaatatttaattgtcctaaataagggttcatttatcttgatctcgaacttgtttcgacggatccatgattttacaatctaagatccggtcactatagacatcttattttcatgatcgaataagaactcggataattattcaagctctagtgctagtggattattacgtcaactaatcttgcaatatattattgtttaaatatgggaagaacagaaaaatcaactttttatcaaaaaagagaaggaaaaaaacactaaattgaatttattaaacacgttctccacgtgcgttatagctgttcgtaccaacagcaaaatggaccgtccaccaattagattagaaccattcaatgttatacttttcttttttcacgtgtcacaagaagaacttaaaaatgaatatgaaaacgaaaaataattcctccaatccaaaagaaaaaagattttgaaaattagtacacgatagtgaaatgcactttatcaaaaacacaaacttgttttgttttttcttattatgtttaataattaaaaaataatctttacggttcatataatttgagtttggctacttttcttacttcaatttggctacttgtataaaacagtgagataataatttctttgacgttaaaattacacaatttccaaatgcagaaacttcaacaagagacatgtagggaaagaatggtggcttgtttggcttatttacaatttttaagttttaatccaaagaaaagaagatcccatcactcttttcaacaaaaaaaaagttatcaaattaatcattaaatcagtcacgtaaacgaatgttttcttacaaataattttgggattcgaggaaaattaccaaaaaaaaattaaaatagaataaaataaaataaaatgaaagacttcatgagaaaatagagacgaagttaagttgtgtttggctttgagctttggctacttgggatttaaataccacttttttgcttcttgtacccctgcttcatcatcacgcacacctctcttaacttcttcgatctcttctttttctctacacgattcgattgattcaagtatcaatcaatcgaatccgagataagtc

SEQ ID NO: 254 - DNA, 3000 bp, Arabidopsis thaliana
gacgacgtcgtcctcacgactatactggaaatgtttcatactgtcattacggtttgacattagaaaagggctattcttttggttaaagtcatttagcttaaaaacattgtaaccacttcaagttttatttttttcatgttcttttaacgtttttacgcatagattaaaacattacttgaaatgtaaatagatgtatactcgagggataaggaaagataatgaagcgttaatcaacggttttgtaaaatctaactatttatgttgaatggaattgaataaatattccactccaaaattcattaaaaaaaaaagttcacttttcaacatattcatttcaattttaaccctatttttgtggacacgggtagaaaagaagaaaaaatcacttttctaatcatatatctcaatcgttcttagtgtactaatcgtatttgtaccgcggtatttcccaccatattatttgtttaatgttgtagtttttgtagtttatgagttatgaattaataatgttactagatcctactatattatttgggaagtacattttaaatgtaaccttaatttttgtaagtaattacataggtatgccattagaaataaaattttaaagagtaaattaatttatctctttaaggattaaaaagtcaaatactaatttaattaattaaatttaattaaaaaacgaaatacattattaatttccaaaaataataaccaatcaaaatcaacatataagatttgatatctaaattttaattaatttaatttaattagaaaaacgaaatacattattaatttccaaaaaagtaaccaattaaaatcaacaaattatatttgatatctaaattatcatattaattttttattaattattatacttcacttctcatctttatatgattctatttttgcggaaaaataatatcatcattataaaaaaataattagagttttttcccatatgccattatttgaatttttaaaaacaaatataaactgttcaatacataaaaaaatattataacgggtaaaaaatagatttaagaaaattttctactgagtaacgagtcataatttgaaatatttatattcaatttcatacatattatattgaaaatttataatcttatatactacaataattaataacatattagatgtgattcaatttttgatacaagttagaaatcctagaattgcatgtttagatcgatattaatacaaaatggtatactataggtgaaactcttaaattaacaatcaaagtacaagtgtataatcttaaacactaaacaatatagataatatcaacaaaacatatacaactcacagtttactatacatttaaaatcaaataaaataatatcaaatatttttaaatcatctttacaataaaaaaattttagtttaactaaaatatatactgcaggttaatatctagattatagggcttattggatctaaagacggatcatcaaagattttttaaactgaagcaaaatatattgaatattcaaatatctatctgttaccaaattataaacaaataagtcaatttaatattttatatacaaaatcaattaaatcttaatcacataaaaattagcacaaaaaaagtattcatcaattaaaaaattatcaaatctctgtgttatataagttttgatactatattcgaataaagtgtaatataccttttcaatttgtattctttaactaatttaagctaactaatatatttgctaatcttatacctatcaaaactgactatcgtttcttatctctatagtatttttgcaagacttttttggtggatttggataaaagtgcattcgggtcatatgatacattctcctattaaataaatatggtgcactcttatgttattagctaaaatgtttagattctaattcagagtcataccattaataaaattaatattaacaaaataaatagctttttggcaagacggatttggagggacgggtttttgaatcaacattaataaaaaagtaaaatataattaatcgaccgtttcaatacgggttaaatctttaatttattattttttaagaccactaatattaaacatatcaaatcatcctaatttagaaaagattatataaaaccaaaaatgttatgtggtatgtataatgttactatatataaaattaaactatagatataaatgtattagagaatgatacaatttgcaaaacttttctatataaaaaattattcttaaatgttaaaaattactatttaaaaaaaaaaatcatgggacggtaaaaaaattacagaatgagttctattttggaattgggttatatggtggatgtatttgaatcaatatttataaaatttaaaaatattattaatatactgttttaataggggttaaaacttcagttttttaacaattatctcatggattcgtggtataccgttacttaataacaattataaactgtaaaatataaatatttaataaaaataaaatttgcaagttttaatatatattacttttaaaaaataaatcgtcccgcgatataccgcggttaaaatctagtttgatatttatgaagttgtactcaaactcaaaggtcaaaaccaaatgctataatttcatctttgtaatggacctacaaatagaatcataacgaagatcctgactgttgacctaaaccgtggagtccaccagacatatgacttgttgtcggcaacactttggtttttagttaagattaagcccaatagcccaatataagcccattagtgtaggccctattaagtccatctacactcgaaaacttcatcatcatcttcaaggtttaagattggcttcatgaatctccaatcactgttctcagatgattgtttaatcttatctgataaaaatcatttgcttccataattgttactgaatcgtgcagaactgatcaatcacgggtcccaccacattgtttgtttcaagaagctattaacgtcggctgattccaa

SEQ ID NO: 255 - DNA, 3000 bp, Arabidopsis thaliana
agatctgagtctgaggacagaaatggtttgaagattcactaacccagaatcggagatgagaaagatacattgaagcatctctaacctcgatgcgtgaatctgcaattgctcagctttcttctcttcttcgtcgattttgggatttggcttggaagtacaatactctgacccagtcagaggcttcgaatactctgacccagacagaaatgatgattttatcttggctcttgggctttatttctggcgaggcccaatgaatatcatgggccttctatagtttttaacgttagttttagtttttgtaactttggcttgctataggattgaattttcatcgtgttattacgtctccgatttgcgtacctcacgactgttttataaattataccggtatggtcgatctgagatcacttgtactggtgatgaattgatataggtgtttgataggtcccaatcaaaacataaaggaacaacacaataattttttagtttgtagtttttgactctctttttattttttggatttcattgattgaataagaaaacagaaacaaagattcaggacaggtcatccgtagacacaacttgtcacacaagaaagtaaatatctagaagaaaaatcatagaaggggaatattttcctattaataagcaacgagaaactttataacaaaaacaagactttttttttttggctgataacaaaaacaaaaacaagacttagttttcgctagtcgatgtaatgcgggtcactcttcacgtgaatgagcctagtattacgtacgttgcatgtcagcgtcacgatgagtatagcttatcgccgataaggtcttttcactcaaatgggcctaatatcaacgtcatcttgagtgtcagcgtcacgttacggcccattagtgtttaattgggatttcgcgagcagttaggtcatctaagttaaaacattaacacatacttgaatcaagagataaaaacaatctgaaaacgaccaaaaagttaaccaaaccaagactaaaaaaatgggatgataaaacattgaaaatttacaaatacagcaaattcaaggatcaataagctaacaattattcaaaagataaagggaattttggaaaagaaacaaattataaactaccttaatggcctgaaaaatagattgatcctagctagctagaaccacgcacatagttattcgatgtcgtgaccaaatccatatgtggctttacaatttagttagttaagttgatctaatatgttgtcttaatgaaacaatttttttttttgaatatacatgccttgataataatatcatataaaataacaagaaaaaatactaaaaataaaaatttactactatatataaaaaaccttctactaaatttaattgaatgttttgagtaaaacacaattatgctttaaacttttatttatttatttattgaaaaagctttaaacttttatatagcagttattattatttttgttattattttatttcaatagaatattatgattattattacaaaaaaaacatattacaagagtcatacacatttgacattactcgcctatttcgttttttagatcccacaacgagttggaaaaaaaagattccatagaatattctacactcaagaattagtcaaagactcagagtcgtggatagactagtttgtacaaaaactaaccgaaggaattgaagtgaccttacactaacttctactccataaagccataataaactaacattatcctatttttctgattttgtcatccgtatagtaaacaaggtcggcccattgagaaatttacatcacaacgacacttttccgttttttttttttttttttttctaaattacttggtgaattaaaggtagtgaacgccacttgcggatgcatggtacatcgcggcaaattttataaaaatgtagaatggggactttttcatttatttaataaataatccatttatttggctttaagaaacctatcaattaccaaaaaaagaagaaaactagaagaaaaaaaaataaaactcgagatgtgagtaatttcatagacttgattggtttccgaaaaatttaaaagtataattgataaaatgttagattaaaagttaatttaatagctataaaaaatacaaattgagaggaactacacacatttttttttttttatggaacctaacacaaatttttttttttgttgaatgcagataagtaatacctacttgacagaaacaaactaaaataaaataaaaataaaaataacgaaacataaccttatgagtttttgagtcatgcaattaaaaaatatatatgattttaacgtccacatatgccgtaaatagtcggtcggtcatcggtcagacaaactaccataggaaagaaatttaaacatggaaaatagaccaaacgggaaatgggcccaacaagacttttccttgtccacgtgtatcatcaccgcctactacgttccacgtagacacgtgtccacataataaccaatcagaaaatcccacactaatatagtgtattaaataccccatacgacgtcgtatatctgaagtggaacccattgataaacacataaaaatgaccgatcaaccaccacgagctcgatttaaaaaccttgatgagtcgaacagtctagatactgacacgtgtcgttatgtaacgccgtggcagcacctggattatactgggacccactgtaaatagttaattcaaaacgaagcttcgcgcgcgtatcctaaaccgttagattccaccatattgttgaatagccgttggatcaaaatctttctctggaaacgtttagtagtcggtcgtatttaattatccaaagtaattagcgattaatcttttaattaattaagacaaaatcttatataaagcaccattaagcatcacccacatactcagcacactacacacaaactaaacgaaacaaaaacaaacacaaacacaaacacagaagtattttctaaaagacaaagaag

SEQ ID NO: 256 - DNA, 3000 bp, Arabidopsis thaliana
gaacaagtagtcttggaagatgaaagatagtgaatgagttgttccataaaagcaaaactcgaagttttggatagttctccaaaaaccaagatggagatattccggtcaacttgttgttggagagattaattagacgcaaatctttctgctgttgaagaaagctaggaactgcttccaagttgcaatattttaaatcaataacactcaaccgaaacttcagttgtagggagatttctgactctatatgcagcaaactagattttgatgaaagtttgaacaccttgagcttagaaaggttggcgatcaaatcgaaagagaagaaaccctcaaacttattatctgagagagataaatactcaagagaatcaagattgctgataacagatggaagcgtcccattgaattggtttgaagacatatcaagaacttggagttgggttaagctactaaaacactgaggaaatggaccggtaaattcgttttgactcaaatcaagctcttgcaaattttttaattgacaaagtcctataacaatgacaagcaaaggcacattaagattagaatgttttttttcttttaaaaattatttgacaaattaataatttaaaaaatacttatatgcaaactactatatatataattcctaaaatgctaaagaaactatttttttttagaaaaatgaccggtttacaaaatgtttggctgtatatcatcttttgttcacggatattttgatgaactgtcatgtatatactaaaaataaactcgtatccatatattttgtcaaacacgtgaatataaactctctttttttgttttttgggttcaaaggttaataactgtaataataatagttaaattaattttcatgatacataccttctcttcctaatgatccagaaaatgtgttgtcacttaaatccaaagcatgaagcttatgcaaaaccgccaagcctgccatcagtatatatatttttgacaaaggttaactaagatgaatatttgaaaagagaatgagaggtgaataaaaactttagtagtacctggcacagggccattgagcaagttcccacttagatccaacagttctagattactcaagtcttttagctcttcagaatatatgaacacaaaaaagaatgaagatgagctgaacatatgtttgaaactaataatatcactttggaactggtactcaattacatacttgatattcaaatgcatatagactagaaaatgggcgtacctttcattggaaaagtaccttccatattgtttccatgaagaattaaagttctaagcgaagaagcggcatttagaaagggtaagacactgttattgacttcgttgttacccatatcgaggatctcaagtttttttaatttcccaaggcttttataccctataaaacaaaaggccaatagatcttgtaaaacacttttataattggccaatagtctctttcaaaactagaaatctccatactaactaattgttcaaagactcttaagataattattccaccacttatttatactattcatattaccatgcacatgtattaacatttcacaatcttgtccctaccaagaaattaagcaaaaaagaataataaatggaattgatgaaagatataccatggatatcatcgaaccagcctgtgcatccgaaatcatataagtttaaagtccgcaattcttcaaaggggtgaaacaaggaaagatttatcaggattggatcactgaatgtttgattcaagaagaggccgatcacacgtccacttgtacgatcacactccactctttcccatcggcaacaatcactcttcgtgtcattagaccaatcatatgaatattccttgttcacataagccttgagctccaacaatcccttcctctccttctcgatgcaacttatatacccttgcatttgtagtgatacaaccatgacccatgctgcgaagaaaaactgcggtatagtgaatatcaacatttctgcaaataaccaatacaaacaaagaaggggaagagagtttgtagctcaagtcaatgacttggtaatattatcgatgatattatatgaagaaatctttagtatctttgtaattaattagatcgtaatcttcaagaagattttggcagaaaactttgacttttcttttatgtgttcaacggtttattgtaaaacattgataaatcaatactaaataaattaataagttttataaattaataaaaaaattctgttctgaattgtgattaatgtaaaaaatgacacaaatcgataaattaataagataatatttttttataaatatatgattttattaatattataaattaataattatataagtgtattaaatatatatataatatatctaaaaaaaattgaaatatattttaaatattgttttgcttaaatttgtatttgtttttatttgaatttagttctaatattttacacaattatttttctataaattaattaatttataaaggtgatccttgttaactaacgtacaagtccaatagtaaccaaattgagagattgggctttacaattatagccaaatgttttaacttttaaccgtctaaaaatgtttgatctgtgggattatatctttcggtcttcttaatggatcacaaaaaataatattatcattttcttcaacaacgattggtgctggattatattgacaagtggatatgacttgtgaccaggcaaagagacgtatcacttgcgtaacttttcttcttctctagataagcttttgccaactcattctcttttattgcaaaattcatgtgttagttcttcttctttacaaaattgagtttaaactgttttattactaatccaaatgaggaatcactttgcactattaatagaaaataatacacaaccaaacatctaaaagatactataatagtagagatcaaagacctgagcaaaaactgaaagaaaaaaaaaaaaaaaaaaaaagacttctcctcaaaa

SEQ ID NO: 257 - DNA, 3000 bp, Arabidopsis thaliana
atttggtctatgtttaatgtattgaaagttcgttgactttttcaatagaagatgtccgttgacttttgttaagcttctcattattgaaaatttggaacttaaagacgttcaaagcttgacgaagacatctttagaaaccctaaataagacttggtcatcctcaaaccccaaaaaggcaaaaacattacgttcctataagattatgttcctattatttcttgtaaagaaaaaatagaatgttctgaaaataattgtcgtaattaaaaatttaataaagaagttataaagtttcctgagttatatagataattcaacgaaaaaaaatctttcaactttggccaagtccattttaattccttctatccacacgaaacgaatttattaaaccaaaactttaaggattttaatacaccaaaactttaaggtctattagggtgaaaatataaccaaaactttaaggtgatattttcactttaatacaccaaaattgagatttcttttttatgaaataaaaacagtttggaccaaatttgaagaattattacggaaaatcattttcccacgtttcagtgatgagtgaacagcataacaactaaaattggcgcttacatggttttttggtggttcatatctgtttgtcctttctttatttattttctggttaaaatgttacataacttcataccaaaaaaaacaaaaaatgacaagataccatgtgtaaagttatatactacacacaatttggttttagtagaaagggtcgaatgtttatcggaatatcattcaatttttttgtggtttttttatgtagataaagttgtataggaaataactattctatcgatcgagatataactaacttgaccaaatactatagaatatgttcttcttcataaaatattggagatgtgccataaaaagatgttgacaaataattaggcacatgcaagaaccgggttcgataagttgaggaataccaaaacggaacacaaacttggagaagatgacgtaaaggtcagatttggagcataacgaactcaaggtcaccgcctaattactttttcatccattgacgacgtcttctaacagtaacccttcattcttcatatgattcctacgtctccactcacatgagatactagaattctataatttaggtctatatatggtttttggctattttatgacataaacgaattcaataactaaaattcacaatttaacatattatatatgatgtcatgcatgataattgccaacttgaggacagaagtttttatttttggacggaagtttgtaaaagcttgcatccacgatttaaaatagtgtttgcatgttgtatagttgaacacgtggtataagaaaaactaatattttcgatatcaattggggaaatatacttttttggaagtttctcatcgttggaatgaagctctttaccctcctagggtaaaatttcttatactacgtacatttctttacgcggaagctatagcttataaagaatcggtctattgaccaccaaatggcccatttctggactatgtctcgtttcatgtatgatggaagaattggaatgacgcatttgctcgatgataggaccgattatgatggtttagacaaaacacatcggccaatcatcagattccgggggttttgtttttccattaagctaaaataaaaataaaaaatagtttgtgttttactggtaaacacaaacacgaaaaatagttttacattcgtgtatatattttttatattccaagaaaatgaggcgtcataaatcatagttcatactgttggattgctgttaatgttatttctatatcaaaccaaggcaagtgataacaaaaataagaaatgtaataatgttgacttgtaaataaagtaagaaaattaaattctgtcatttcagacgaggaagtatgtcacatgtaaaatagatcattgatacttttcatgagaacttccataagaattaagaaagccattgacttctacctttcttaatttccagcttgacccattttttctcatgaaattataagaactttacgtattaaatatataattattttaaatatgtttatagttattatgaattttaaaaaatttgtaatgtattaaccaaggttgaaattatttgatttgactttctaaataccaaaattcatgtaatttcttttagttcttaccaaaatatttgtgtggtatgctaatattcgttttatatgtaatttctgagaaaatttcatcccaactaaaatattaagtggcaaacaatgtatatagggagagattctacttttcatattgtaaattagagtcatatcatatctataatgttcatctaatatgtgataaggagaacaaaaataatggcaagtttggaaaaaaatcattttgcatattttgactcatttgcatttttaaaacctttttcttgatccttctccttatcttatcttttctcaaattctatatttccaaaataaaacacgcactttctattttaattataataaaaaaagagttctcaagttatcttccaaaactggtctttaccactatatttcagatttctcctccacgtctactgattgtcatagatgatgcgttctcttcttgttcacacgtaagtacttcatttttttgggtgcaaatgcaacaattcacacgtaagtatacttttcacaattgcttttttttctttgttaatatatagttatatactttccataatataattcaaggatttctcgtgaaccgattttttaaaaacagttagctaatgcatatctttatttctacataaagaaacacatatttagtctattgcttctctatcaatattcttctttccatatatatatgattgaattttaaccctcttacaaggaatatatttcatttatacattatatatagattacaagaaaaccccatcactctatattatcagattcatcatcgaaggaaaaataaaataaacggccaaaa

SEQ ID NO: 258 - DNA, 3000 bp, Arabidopsis thaliana
gctgctataacacatcattgagaattgcaccggtgaaagtaatatatccggtgcatacttcgttgtttgttatagagttacataacaaaagttttgaggctgatatgttcaaaaaatcaactattcatttgaagccagcaattccatctgctctgtcaaaatctcaaggttcctagacctctcaggagtaagctgtccaaattcaaagtcatctggtttctccatctcttctgatatcagcttaagcatatagctcttgtctaattccattgttccatcctcctcctcctcctccaatgtcaaatcatcctttcctttcttcacaatgttctcctgcttcttcgtcttcttccttgaagggctcaacaacaaaagcttttcccatgctccatcatcgtatagatcaggtatgatcaatggcacatggttttcatctaagcagaacttcaacatatcggcgtttctcaagaaatcatttacgtcgttcgagtttgactttgcagttccattgttgtccgatggtggctggtatgttactaaaggaagaccatatgagtttgattctccttcatcagtcacttcttccacaatcttcgctccttcccccgcttttcgccaagtgtttttctcctttggctgaagtaactgaactaaaagacttggattcttcataaccataaccaaaaacgaaagcatctcctgctgactctcttccattccttgaactctgtcttctaaatgtaacatcttagtatccgtcacctcctgatactgcctaactttgatcaactcctgcgccaatacctgcttatcacctttcaaaatatcaacttccttccacaatccactcttttcctgagcatatgttgtacttgtactctcatgtttgctctgctcactactttgaacattcttcctcctgataacattcttcagcaaatccttttgacctctcacaaacccgtcattcgcaaactcccatcgatctgcatcaacttttctaaaaccctgtaaacaaacacatccacgaatcaggcacaagtctactcaaagatccaatgagccagatttaccctagatcaaccaacttatactatcatagagtcttcaagattgtgactagtactagttctaaacactgttccagataatagaagttgaacaaaacatctttcttcatgcttcataaaccaaattcataatcaatcttctctaaaacctatccacacgttgtaaaagcagagaaaaaatgaaactttgctaaatacaatcacaccatgtaagagtaagagacataacaaagaagatccaattgtacaaaattgaaaagagagaggagaagagaggactaacgtagatattgagctgacgaatgaagctagagaaattgctgtgtttaaagtatttaggcaagagttgaacagagaagacggtggtgtccaagataacgaagctattatctgcacttggactccatgagattatagagtcagtagtagaatcatcaaccatatcgtaacattttctcaagaacggcgccactgaagaagaagaagaagacccaccaccaccgtccgtcgatttcaccataatcgagaaatctctaaactttagatgaaattttgaattctgaaatttgggattgaatcgattagtcgcaagaataaggaaaaatgaagagaatttgggattggggtttatgtgggaaggagatgaaacttgtgcgttgggcaagggatcgtcgttcacatcaaaggaaatttcaaggaagagaggaagaagaagtcacggttttagatatttttaagtctttggcccaacagatatttttatttaaaaaaataacattttacgacgttaataaaacatatttacaactttaatggaaatagaaaagtaaaacattttacgacaataaaaaaatattttacaatttttaatgaaaatagagaagttaatataaaaatttaaattaaatcaaatgaatgttgtgtattttcgaatgttaggacttaataagggtttaaggatgtgaaatcttaggaattattattttaaaatcatttcgtcatttagggatcttgatgatgaggatgcccaatctcctatgccacatcatgttgcctaagattagttacatggacatcacattgagcttggggtgagagttcaccataaactaaaagattccagattagacaatccaaaaggtcaacttatcatatctctggaacacttattcaacaaactttgcttaacttacaatgacagattacaaaaacccaaaagatcttttcttaggaggtttgaggaatcctctcctcaagacattctgtaacttttgtttttgctttttatcgacaaccttcttacttagttgtgaatttttgcgctttgatgattcactaaactttaaatacatatcttggaattttttaagtgatttcttcatgcatacttgaaaaattgttagaacatgttgaatattattattgtttcatccgttgaagcggattgagggattgaaactgcaaaatttgaatcatctttggagatttatgctggtattcgttatgttagcattcgaattcaaatccgtttttttagtaccttcaatttgatatattctttaaataattctatactatatactttttttgcattttaaatctcacataccaaatttatattagtcaataaaactacattgcaaactgttcgcctgcttgcatatttcaacatttgtatgcaaccttaagagagaaaaaaaatccttaagaaacataaacgttaatatattcgcatcaagtactgtctagataattgattttctagtcccatggttgaaaagtcatggataagatcaattggtgtgttagtccttaatttgggtcttattagtagctcaattagtttgaccagaagccaatatatatattgacatacatctctcgtttataacaacgaacaatttgcacacaaccacgagactcaagagac

SEQ ID NO: 259 - DNA, 3000 bp, Arabidopsis thaliana
caggtatgtaacaggttctacactatgtagtctttctctttcatcttcatgttcaagtttatgtatttgagataatggtgattggcagcttatggacagttcttgaaagcaaatggagaacaacctgtgacatggaaacgagcttcgtccatggaggaggtgctgcgtgaggctgatctggtatatggaattcacgcagacacaaactattcttcgtttgttaaacatttctagtgtatctcttatgaactggttgtgatctgaaacagataagtcttcacccggtgctggacaaaaccacttaccatcttgtcaacaaggagaggcttgccatgatgaaaaaggtggtttcacttttcatttggtctcctcttattattattgatcttgttctgattggatttgattgcttcaggaagcaatccttgtgaactgcagcagaggtcctgtgatcgatgaggcagctttggtcgaacatctcaaagagaacccgatgttccgagttggtctcgatgtgttcgaggtactgtcatatacgctatgatgaacccaaaacatactagtttatctctgggagcttagtaagtgttgttaaatcacattgtttcaggaagagccattcatgaaaccagggcttgctgatacgaaaaacgctattgttgttcctcacattgcttctgcttccaaggttacaaactgaagaaacgtttctttgtgtctaaatagataattaacagaactgaccttaacttaacttcttctgatgatgacagtggactcgtgaaggaatggctacgcttgcagctctcaacgtcctcgtatgtattttcattccaagaaaactcattcttataagattcaaaatgactaaattctgatcagcctctgaaaatgtttaacagggaagagtcaaagggtacccgatttggcatgacccgaaccgagtcgatccattcttgaacgaaaacgcttcaccgcccaatgccagtccaagcatcgtcaactcaaaggccttaggtactacacaacacttacactcatgcctcagattgtttcaaacgctaatttatgcttgcatttcctgttaacaaaatatttaaacataaacagaaacaaaagaacattgactaatccacttaaacaaatttgttcccattctctctattaaaattactctcatatatatattctttgggttttttcaggattgcctgtttcgaagctatgagttaagtatgaagaaggggagatttggaagaatccttttagtgaatatatgatggtgtcaagttgtgtttatgtattgtatatgaaacaaccatgttggatcatataaatcactcctttaaagtgttacattgttgatgagtctattagacgattacccactctctttatttcataaatttgctaagaatacaatttctaagtcatcaagaatttcatctctagttgtaggatttgtactcatgaatctaccatccattcccgtttgtaaacttcacagaacagttttgaaactttaaaaaatctgatttatgacacaaaacggtaatagaatttttacggaaaaaatataaactactggaacagttaaaagcaaaaatagtggtagagcatagtaatatacacagagataagcagaaaaaatcggataaaaccgccgattaatttttatttgacgatttaatatctgttatattaaatttggaataaaaaaattatttaattttgattgttttttaaagtcctcgttttttaaattttagtagattagtatctcaacaatggtaataaaatcgcgataaaattaatatagaataattcatttcataatttaaaagttatattctctctcttttttaaattaattcaatttctgagtttttactaatattagataagattataatccataattttttgaaattgacaattctttcaaactttaaacctatagttttcaatttaattttaaatttacaatttatcgtcaataactaataaaaaaatagaaacattttagcaaaacaaatatttttattttgtataatgttttgttttctaaaattgtgtttaataagtaaccgaaggaatatattatattgaatttttttaaaataaagtaatgctaaatataaaataaatgacactctatctttagttgacaaaagcactgagatctcgccacgtagcatgctgagcaacggacaccacgtggtgttttgctgagaccaaaaccccatgtgacagctgcttagaggtcccacttcggtctacgacactaacggataagatcaaaccacacatttctctttggtgtgaccaaacttgacgtgctcttctctttttccacccttcgatatatcttcatcggacgattcaaattctcaaatatatactcatgctctcgttggatacattaattgttataagttgggttttaacttttaaaatgaacagtttttcatatttgggtgtgtatttttcagatatataaattccaactcctgttataaatttatgtaaacatcgttattaacactaagagacgcacaagctctgtctgagaaaaaaaacaaaaagctaaactattttcattataattccaatctcacacgcaaaaaccttagaaacagaaaatatatctgtctgaagaaaaagtgccggtaataagaaagaaagaatcacctttctctactttgtttttaatttcaaaagcattttctcatgaagacagtcaaaaaatctctttttgtcttctcaaatttaaacctcacctttaatatttctccttacttttgaagctgtaataatattcttgaatctattcctttctttctctttctcatgtttaatcggtgaaggctttactctgtttctttcatcatgtttcaatcaaaagccttaactttttctttagctctttccattacaagagacctctagcttcatactttttataaaaattctctctttttctcagtttaatctcaagaa

SEQ ID NO: 260 - DNA, 3000 bp, Arabidopsis thaliana
tacaaatgtagtctggttggtataagccttgttatgtatgtacgattgatgtcgtagtcaatgtagttgataccgtacaattcgatctaagctaatatttttgtcgtccgacttaaaactatataagcatcaatgttttggtgattacgaattagcaaaaacacaattttcaagaaggaaaaaaaaaatatttcacagtaatacattagacactcaatgacagctaactgtaaacaaaaatacaaaacacaaaacagtgtaatacaaaagaatttttatgtataaaatatgtcggttattaaatatccaaaaatgaaaatgtacttggatgttacagctatgagacaactactaagataaagaagaaaaaaaaaagggaagcttcgaaggtgggctttggctttgatacagacgtgcacagatcctttcccatgtaaaaactttgataattctgacgtgtaatttttccattggtaaaacatgttttgactttttacttacgtaagtggaaacgcattttgcaaaaaaatatcatatccctcgaaacacttatccattcacagaaacattctgatcctcgtttttagttaattcgtgtcgaactctcattggttcatatttacgagtccccacacctttagccgacgttggtgtctgtctggataaagaaagaataaataaaacgtttattttctataaaaatgttttgtttactattttcacaattttacgaaaataagagaaaatggaatttttttttttcgtgtggcggaaagtattgtagtattattttttctcttttgggggaatattatcaaagattcaagaatgtatttatttatggaaataaagaaggtgtttgctttttttgtgtgttcttttaaaatctttatataaaagaaaggtatctattgtttggttggtataaatacgcatgcgcattggctttttcgagtagaggaagagactagatagagtcgtgattttttttttcttttttaaattatcaaatggacgtgaaattatttattgaaaaataaacaaaaaaaaaaaaaaaagaagaagaaagagtctatcggatacgtcggatccaatctcccaatccgcattggctgtcgagacaacgtggatgtaaaataaggctttaagttcaagatcatttacctcaaagccactgagcctttaggttaataacgtcctaaattggctaatgtcttcttatgacatactcaaaatctatttttcttggtcgtcaaaattcaatactaatgatgtatatagatgcatggttcattcacaatatagtgtacttggttttttatgcctttccagtttcctataagtatgtatctatatagtatttgattttctaatccttcatataatcttaataaataatattgagttcaaacataagatatttctttatatatggatagagtctctagttgatcgtgtgtaggtgtttcatctttgaccagtggataacgatcagattatttaatttgaaacgttgtttccactttgtagagcttagactctatgtcactatgaaacgacttgtcaacaaagcattttgagccaaataatttaacatataacttggttaaaagacgagtttacgattattactattcttaaagttaaattatgtaatattttcagatttagttttcagtagtcacatgcttaagaacattaacatcagaatacaaccataatgattaatgagagatgtatgcaaaatatatcaactaatcatgttaaaaagggttgtaccattaattagtgatgcttatctgcttcattaagataataattaattttcaggaaaataaaactattgatttgaaattcttttacaaaatatcgatgaaattaaatcggcaataataaccaaaaatatacttttaattataaatgtgaaaaagggggacctcattatatccataaaaaccccagacaaataggtaagatacaagttgctaaatttaattaaaatcccaacaacaacaacaagattatctttaaaatacaatccatcctaaaccaaaaacaaaatttggtccaccatataaaaaaaaacatcatatgctaatatatagtttccatctaccaaactcaaaataaaagataagaagataagaagataaaaggacattaacgtaattttaatcacagcgtcccaagaaactaatccaaaacattatcgcgataaaaccgtacagagcaaaaagctactaataatattattattgaaataaaaatagatagaaaaaatagatcgttagaaaacgtgtatatatatatatatctgtgtattttgcaatatatcgtttttttttcttcgttatcgcattaatctctctctctgtatcttctcttgagtggagcgaatatccaaaagagttccgagtttctttcatccttcacgagcttatactttttcttctccattcgtttgtttttaacgatcaaaaacaacggcgaaggttagtctccggcggtttcttcgttgagatgtgacgacttttttttttgaacgtttataaagattacatattcatgtatttagatttcttttgttatgttaactgtttcattgatgttcgagttaattttaatttgactcaaacacggtaatttttttttaatcttgatctgttttgttacgtaatttttgggttgattttagcctgaaatgatgattttttttctttctagcttatgtttttcgtgaatcaatctttttcaatataaagattagtattttgttgaaattcattttttatttgattggctatgaggaatcagtttcttgaaatggaaatggtgatttgatttgatatgttcacaatatgaatgaagaagattagggttaatttatatatatgaaacaagaaagtttgtttatttaaggtaattgatatatttgttttgttgttattgccatttttaaggtattggaaataagacagaagctgttagctctgtttctcc

SEQ ID NO: 261 - DNA, 3000 bp, Arabidopsis thaliana
atgacttggctgagagatatacgattcacagcgtcggctactctgcacggggtaattttcctgtagcagacttgtgcatactataacgtcttaagtatgtccaatttgaaagtttactttcaagattatgggagggggttttcaatgtaatgtcaaggaaaatcttgattcaatgtgaaaaaaatatttgctaaaccagcttttgttttagggtgcgctggtcgcaaattttccatgggatggtacagaggataaaaggtatttacttctattcaaatggttttgaggctaatatctttgctcggtccttgaggaaatgcaaacgtcatgtagttgttttgcactcttcttgcaggaaatactattatgcatgtcctgacgatgagacattccggttcttggcacgtatatatagcaaatctcaccgtaatatgtctttgagcaaagaatttgaggaaggaatcaccaatggagcatcctggtatcacatcaagtccccttactctgtcttattcaacaaatgagtttcttggttaatgctttaagcaaaacgctctacaggtacccaatttatggtggcatgcaagactggaattacatatatgggggatgctttgaattgactctggaaataagcgacaacaagtggcctaaagcctcagaggtcaaatcttatattcctatgtgataactgtttctccttcgcaaggtagttagctgatactaatagagttcacacatgttacacagctttccaccatttgggattataatagaaagagcatgctgaatcttgttgcaagcttagtgaaggtattatttaacctttgtttttagaaccccaacattttaatcttgttgtatcattttagattaagcctccagagattggttacattaatggaagtttgcacctttgcttccattgttatataaaatattttctgttttgtttttttaagtacgcctttatcttttataccttagacaggagttcatgggcggatcttttcattagacaagggaaagccactgcctgggcttgttgtggtcaagggaattaattatacggtagacacatattaaccctgccttctagtatttccttattccaaaatctgaaaaatcttgttagttcttcattgctcattgtaatccttatgctctacaggttaaagctcatcaaacatatgcagactatcatcggttgcttgtacctggacagaaatatgaaggtctgatgttttttcctcatattcagcttaaaatacgtgtgattaagttcttatcagtatgttattagagttgtccactgttataagattatgatacgagctgattttagtgattcatccttaagaaccgtggggcgtacaaatgcactatgatatatccttcataacttgtgcagaccaatgccttctgttataagctgacgctaacgatacgatatctgcatttcatctccttgttattgttgattacttgcctcattttgagtttcctttactgattcgcagtcacagcatcatccccaggatacaaatcgaaaacaacaactgtttggttaggtgaaaacgctgttaccgctgatttcattctcatcccagaaacaagttcccgaggcaatcaactgagaagcagctgcgactgtagctgtaaaagctgcggtcagccgcttctaacgcaatttttcacagagacaaataatggaatcacgcttaccctattcgtggttgtagtgttcctttgttttttgttgcaaagaagggtgagattcaacctatggaagcaaagacaatcctctagaagatcaataacagtatgatttataggtataataacacaactctatatactctaataagaacaaccaaaatccaaacaattgagtccaattattcaagtagttgttacattattttataccattgaacatttctttgtatcgttgtactttatgtgtttggtggatcttatcatcttacaagtcttgtactacgtcaagagtgcaacattgtcgccaaacttatgtcaccaagggacattaaaaaatgtaaccggaagaaaaagtcatgcttattaagtatttgaagaatgcgttcacaaatgaaatgtgaaagtcaaaacaccaattaggaaaaacaaacaatataaagcagaaatctatttatgctgttatccacagctttcatttagatttcttaaagacttttatagacatgagatttttttctatcttatctgtgtgtactttatttagaaagtagtaatctgttttatcatagaagatctttcttttaaaagtttaatcatttccataatagtgattactacatcgaatctatgacagtaataggaccactatatatagaaaatagtgtttactacataattttctacatctgagtttctgagtataataatatcgggatattcactgcgagacaacggttaaagaacctatcacaaaaactgtataagaaatctcactgctgtctcatagtaaaaaaacaaagacgactatttggatttgttgactttgacctataacaatgaccgtttcgttacgccgttgacttctccgcgccttaaatataccacgtgttttttcctcattggttccgacaaaaccgtcggtcacaataaccgttttttaaaacaccgtcatttgaaaaagccaatcgcttcacgagacaaacgacgaacaacgcaattacgcgttcttatctttctgggtatttcttaattatattactctatataaataaaaatacccagaaacgtaatttcgtcgagttcaaaaattcaattcaaagaataatttctttccataaaaagattgttgtggattaacttctttcttaaaagaatctcatacccgtcgaatcttcttcttcaacctttttctgcgtttttaatattttccctacaaaaagattctcaaaatcgttttacataaacccgatcttgtcaatctccagaaacaaaaaaaaaaaa

SEQ ID NO: 262 - DNA, 3000 bp, Arabidopsis thaliana
tgaatcttggagctaattcttcccacataatacccatcttgtaaacaaaatcaattgaacgtaagtttactggcttcacggaaatagcacaaataaattcgaagttaagaagacctggaatgaaattttgatgtcacagaaaaagatgaagtgtatgataaagatacctgctcttggtctcttgcatgggagattaatgcttgaataacaaaatttgcacaccgatcaactgaaagctcaaataaagaattcttgaaaactttgttgaacatttcgttatacaaactttcaggggccacttccaaaataacctgaaaatggcatgcaaacgcatttaaagagatgactaagaaaattaacactccaattacagcatggaatcaaacagagaactagcaatccttatagataatattttgcatggtctaaagcaggcaatacgtccatcatcaattgttttatgcaaggtacagaatcttggtataaacaactcagtcagagcagccagaggttagactcagttacctccaccagatgactgaatgaattatccttcatcgactctaaaatttctttggcaacattagtctctatatgaaacccttctacttttttattagtagagttgcagcgcagaataagcggaatgatttcaagcaactgctcatcttgtttcagcattagtctgagagccgtctgtcaagagaagattagttagaatcaccgtgaatcagggagagagactaaataacagtcaatactaaagaaattgcttgaaaatgacataaacgattagacagggacataaaacctacctgtaagaccaaactgctatactgatcgacttgaagatacttcatgtcctctctgctacaacttaatagcccagataaaaggtacgtgagcatacctggaaacccttgatgagggatttctaaattattgtcatctagctgagacatcttcagattcaaacgtttggccagagcttttgatgattttgcgccataaagctcaggggaatctaaagagactcctttgcaaagacaaagaagccttcgtagtacatgcgaaccatagcagttgcacatcatatcaagaggattatccacaatcacctgaccaggggaaatatttcaccatcaaaattgaggtcaattactagactagaagcaataatctggataccttaatatgattgtcaaagccagtaaaaattgtataaagtaccttgcatatagaatgcaaagcctcctcaataacagaataggcgtctggattttctagatgtgtggccaaggatttgagagcagactctgcgacatgagaaccagatctatccattgcaatggctgggaacacactagcagaatttcgtatgaaactgcagagttggtcaagttcacatccctcaagtagagtttgcaagacatgacttatgatatagtctgtagcaatttcatactccctccctcttgtttcttcaagggcatttccacatattactgaacgttcctctaattcaacttcattactatcaaagagattggcaatctcagagaaatactttgaagtctctggatcaatctctttcctgaaaaagatacacccaaatcactaccacttctcacaacaacaaaatttcgactataaattagagcaaaggcccttggttaaaaatctcctttacctgacaaattgattctgatgttcgaattcggagtgtttctttgatgctggctttacattgggggcaccaccggattggttcttcttgctgctatctacatcaaatccacggttacccttatggtccttcctacgcattcccttattcctttcactgtgattgttactagactttcctcgttcacccatcaagctatcttcctcaatggtcctgtgcctcctagatggcaatgatttagaaccaacagaaaccatgaaaattcctagccccaactatgttaaaccctacaaaatttacacacaaaaaaactcagcttcgaagaactattagtcccaaattacacaatataacaaaaaagggaaaggttcaattttttctccaaatttacagaccccaaaaattagggtttctacctctacttcaaaacgataccataactgggttgaataacctaaaacataacaataaattccgagtcccaattctaagactttacactaatccatgtgaagcttgtacaaaagaacagaaacaataaggtgtatcacaaacctttgaggatgcaaaaacacagttgacgttagaggagaaacgaacaagcgtgagctcagactaagaacgcggcgcagagacaaaacgacgtcgtctccgaaactcttggtatacgttggatcaaaatcttcgatgttttgacgttgtacaaattttctaattcctagggttttattctcgtccaacctaatacgatatcgttttgttgacgtggatataaacaaataatgggctttaaatcacgattttaccgacctttttagggcccaattatgtagcccaaaaaaaacctcatcgttagcaatgtgctgctacatgttgttgtgatttatttaaatttagagatttctaaaaatttataactttcaaattagctgtaggttttataagtatctatttatccccaaattagattacgactgtgattggattattcaattttggtccttttggataattaagtcaacggaagatagacttcagacatctttttttgataaaagacatgtctttttttgggattagtcgtgtgtttaacagataaatcaacaaaattagccgcctaaaaaaaacccctacaaatatcttcatcaattagattttcgaaaagaaaaaacgaaaaagcaatttctgagcgtggaggacaaggcaaaattcggtgtgcaaggcactggatattgggacccttgtttcctcgtgagagaattttcaatcctagggcttaaagagcacgttcctagtataaagctgattcacag

SEQ ID NO: 263 - DNA, 3000 bp, Arabidopsis thaliana
ggaacttatagacatggttttcacttatcataattaattgtaactttatattattctggtatgtgtgtttgatgtaacttggagctagtacctaggaggattaagagctgagtgcacaagtgtataaacaaagtgattcagtcgttggaataggtatgccaaatgttaaagatgagcacataggttaatctgatagagagggcaaaatttaggatcaataataaagaagagaggccaaggacactaggaaatgagcttgagctcagcaagctctttcatggatgccatctttggtggcaaagcaacagggatcatatcaagacggtttacaaggatcgttggcttatcaaactcttttctaaatcaagccaaaccaagaatttaccaaatttgacattctttaataatttcttttaatttttaactgattgattctattaaattttcacattagtaattataatagatattaagtatttttgtaattttaggccattacaacgcatactttgcagtttgcaaataatttgacttactaaacgttcttcaaatttgatttagccagttgcatacatactttgctatttctttcctattttaaattgtgatagaaaaatattgaaaacgtcccatgggctctggacttatatcatacattcatagtctaaattttttaagacacaaacaaagcccaagggcccgaacataatacacagtaaacaacactatacacagtacaacgttcacgaatcaaatttgtgcttacaatcatatttacatcatatatcattatcaacatcaaaagtacttgctttttttgtgttttaaattaatttgaaagtagtacaacatcaaaattgaataccaatggtctttgccgttgaaaattttaggtgtatgaacttcatactatgaagagttcaaatgaaaatttattcaaacgtgtcttgatatagtattcaaaaaatcaaaggtaaccggtacgttgagtttgacaacgtacgtattgtaaccaataaaaatattggtatacagcttttttgtgtggtcaacttacatttttcatatttttgtatatgtttgactttgtggctatttgcgagttgtaatttcgctgaagtcaaatcgactgagtagcatggcgtttgttcatgaagccggagacaaaaccctgagacttaaccaatataatacgaccatgctcccgctacatctaacaaaacaactggtcaatataattatagaaataaaaaaattaataactagtaattaaaagtctaaaaactttaacgaatttcataaagtaggaataacataaagcgactaatcggcctaaccgaagaggcggcgggtgagcatgcaacttgttgtaccaaaatggtggctctaacgacttagggatactcgttcttgcttggaagctctacaaagaaaaaattatgccttctcaaaagtgtgaagattgattaaacctttaatttgtgaattaagttatgcatagatacagaacattgcatatttgatttgcatacttgatatggaagaatttcttacaagaatcagataccttgataacttttaaaataagacgaaatattaatcagagaaaaaacgagatatatatgaaaacaaactgaaaggtttttggacatttgaaacgtcatcttgtatgcatgaatgtatatcatcttagttttatgatttatgacgatgggtacatcacgaatataactttgggttctgattagtgtttgcattatataacatcttaatacaatttttttgttttaaacttgaaagggataatatattaaataaaaggggatctagatattattgattcggagaaaattataaagtaaaatggattaataacacaatttacaaaaacattaattgtatatacttaaccaaacggtaaatctaccgtataattgatctgattgatgatatcatctcataaatcaacccacatgttatgtgtaaatataacttattgatttctacaagaaaaaaaaaacaataatcgatttcgaaacaagctttttcttatgaaaaaattcatgtgatttaactgattatactgatagcactatccgacatgatcatctttctttgacgatcacaagatataatcaccatttccggttacttttaaaattattttaaagttttattcgtagatatcaaatggactgttttattaaactatcacacaaaccgatcttcaatatccgatgttcgaattatagatttacttcacttgtggtgttttttttatatatattataaagtaaaaggcaatgtcaactttattagacgataacgggatatgatcaccatttccggaaagatcaggggtaatatttgtcattcaacaatcaaacgagaatccgcgagtccattatttaacactttctcgtttgcttccttaacgtttttagacgcgttcgtgtctgactcggaactcagtttgactcaaactagaagatttttttttcttttttttcgtaaagacctttttttattttattttggtttgaaaaaaactctaaatcttttgctaaagcaaaatatatggtgatgcaagtctttcttttttagaaggtagcaatatttcttttgttttgagtaaaagtgttggaaagttaccttacgtagttacgttgaacattaaagtgtccgtattattcagaaaatctaacaacaagttttgaaaaattcgcgttttaatttttttgttagcaaagttataaaaatatgattgacgaaagaaaaacaagtaacaacgaatattccaattaaaaaaacgtgtggacggcgaaaagctctctttcggtcttcccttttgctctctctttctcaaggcatataaatagctgtcacctgccgattattatttgtaatcagaacgcaaccaaataaagaaagctctcaaactcagtcttgaagcttcaactttatatctaccatatcatcaactaactaattctttttaaa

SEQ ID NO: 264 - DNA, 3000 bp, Arabidopsis thaliana
tgcatttgttactgctaggtccccatcctataaatgttttccttttcaactttttttttttctgagtaacttcagagaatccttcaacaaaaaacgagaattactacatacatatcaaaattaggccgaaaccaaaacttacttgtggaaaaaatggcatatgattaggacattggacaagccgttgtaatgtcgtggtcaaagtccatactattgattacttcaaccaacagctcatcgtatccgttggtttgtatgactttatcaaccgaaataatactctgatcaaatcccaaatcggacgaccaaaaatcgaaacgtggagggagggatgaggacccacaaagaggagtcccacaacggaatttaaatcgttggttcatttaaaacactaatcaacgtggtggtcctctttacgtgcaacccaacacggcttggtgaaaccaatcaatccgccaaattaaattctaaattgtaagtatgtaatttattactagtatacattttgttgtattattgtagtattacgtttgtaaatatatttaagtatcatatgggcttgtctggttttaatgcgacaaatattttatagaaagaatgatagagtaaagaacttttgaagactttagaagattagaaaatgttttatttgattgatagtgtttatatttttatatctaaactctcaatccccaatatatttcctaataagaaacgttttaaatttaatatccaccggatgataaacaggtgtcgtatgctattacgtacaattcttttttcctaataggacataagaatctagtaatcatataatttctttggtcccgccgtatttatacgacaaatcaagctaactataagtctataatcaatagtggacacgttatatatcgtgtataacatggagtgtgtaaaatcattagaagactcaagtaaccatttgggctttagttcaattttcatcagttttacagtttgatagtctccaataatatctttcgttccactaactaaaactcgatttaaattatctagtatttgttttgaggatatatgcatccgaataaagaggattcaaaagtatcaaaaagtgtcaaaagaagaatgaaaaaatcataaatggcatagtggtgacgattgtaactttcttattggagtggttcgatttccaaaatcatggggaaaattaaaagttaggcacatcacattcataagagtacaagacaactctcataaaaccaaaagagtcgtttcgtttggtgtgctattttaccaatcgttaagtctatttcttttttatttcctcccattacaacaaacaaataaagttgaaaagaaaaacaaaaaaccaaatgatattttgtctattgactccaacaagataaagtcaagaaacaatcttagtgttcttagatacttttattaaagtctctgcaaaatgctatatggtcttcttctatagagaaatatcttctggttagaaatcattggttttacatggttctatagaaactctctcgaacatatgaatcgattaattctttctgatcaaaccaagtagattgacgagttcacaactttgtcatgaaaatgtcttcatctccacaagatctacattattaaatctctatgatcttcgagatagattataaacttggttcaccaccacctcactaacccgtgagggacatcaattcaaataaagttacaaatcagagtacgttacaaatacaatgactaagaaactcggtttactccaaaccggcaaaactcctctttccttataattcataaaccaaacatcaccatcttgaccatctcttaaaccaaagacttaacaatctcaattcgagttcacacaaattagcattcgattgtgacatttgcaaatgtaatggagataggacatagtattcatcactttaaaacactcttattgataaatccaagagtcacttaactttttctggtaatcgctgttaaagactccaactcaaaaacaatcacattattccaagtcttaacattctgatacgattcattacaagaaactgagtttatctaagattttcttctcacttgtgcattaacatatatacacacaacataacacagatatgatacaatttcacttctttgaagaacgcttgggagtaacagcattaaagatagcttcaatctcttctttcagtcgttgaaagaaaccaggtcctttcacataatcaattggagtgctctcatcaatgtcgtcacttgttccatgagtctctttgtcatggtgacgactcttggacttttcatgatgacccattgcctctatttcttctttaactcgttcaaacacatttggcgatttcacagtcttctcctctgtggaaatacccaattaaaacaaagggtttagattcgtgtttcataagagacaaaacagagcaacgaatcaaaaatagacttatcatggcgtgtttctattgtttctttagagaaatttccgatcaaaaccatccattaatagacgtgtaattttgattgtgaaatttgaggaaacgaacataacttgatcaaaaagtcttcctttttaacaatatgcataaacctatgatgagatctgatcgttcattgtgtttacctgatcggttttgatccgccatcgatggtttttgtcttcttgatcttgcagctttctatttttggttcctgattcggtggcgttttgcgtcagatgcaaaagagtctttacagtataaatcaaaatcgatttcaacttaaatgggccttgttgggttataatgggcctttttgtttgtaagtgagtccaaggaaaaaaaacaccagaccagattgaaattgaatcacttgcaaaagcaaaattgattactctgttttggttttggatcagatcaaccaaaggaagcgaagaagaagaagactttatacactctcgacgctattgatttcgtctgtgcagttttgtttctctatcagttagttttaaag

SEQ ID NO: 265 - DNA, 3000 bp, Arabidopsis thaliana
taatggtaggttcacgttgtgttatgttatcagctttgaccttggcttcacaatatattgttcaaggctgaaagctttgctttctattgttctcgatgttatttattttgtattagactcttactctactagtttcatcatttatgttatatttctgctgtgaatgcagatttgaacttctagaccatcaacatatagagtttgataaatttggtatgcgaaacaatgttgctcaactttgtgttttagaggtatgcaccgttttaagttatttctgtattgtcgtcttccccctcttttctcctctgtcttttcttgattctagaagcacagagatatgacaagcttaattgtgggcattattttatatatttttccctcctgttgtgttttcagctttgcaggctaattgcttaattttcttagtttcagcccttgcaattaattaatttacttgattgtctattacggaacagatgaactgtgaggaggacccaaagtctaaattacgggtgcgatcatcagagtatgtctgagttctgttctgattcctttactggagtgaatattgaacttacttttaagatccttactaaattttatgcgcacttccatgtttggttgatttatgcaaacttctactagtcctcgaaggctagtggttgggaatatacatgtcctattcaatcctaagcgtggggatatcaagcttggccaggtatgtcttgctagatccttacaaaattctgataaaaactggcttatccataaaatcggtagagcatttctgtcactacacatcctgagtttagaaatgtcaattttttagctagtactattttatggtattcatcagtacatcaatgcctgtcagtattgaaacttcattgaaattctaagtagctcgctcatttcttgatatttgatatgtcataacttataggtaagactctttctggagaaggcttacaagctatcacaggaatggggaaatattcctgtggcgattgcaggtgatctgaatagcactccacaggtgatctctaccaacttttgttttttttgttctaatacttattttttagctgaattctaaaacttactctggatttgctgtacagagtgcaatctatgatttcatagcttcagctgatgtgagttccattgagggttctggactctttcttttacatttcgcctggtcataatttttttcctttctttactgggaaagttagaatgaactctttatattccttttttaattttggacagttggatacacaacttcacgatcgcaggcaaatttctggccagactgaagtggaaccaaaggagaggtcattcagaaaccattatgcatttaggtagcttgtaattcaccggggtctttggtttctctaaataatgtatccatattccttttctgcctacctgatgaacggatagattgcttatatctcttctgtttacctgatgaactgatagagtgatagattacttatatttttctttggcctgcgcttaatcaactacgtaatcctcagatgaagtttctatctcaatttagtctaactaaacaactccctctttcgtcagtgcttcagcatccatctccggatcactactcaatgagtggagccaggaagaattacagcttgcaactggtggtcaagaaaccactcatgtccaacatcaactgaagcttaacagcgcatatagtggagttcctgtaagtgtttttgtttcttgttctcgactggtggacgcatcgaaaagagttgaaatctgccttacaggaaaactaagttcttaggaactgtggctttcttttatactagatactgaaaaacgtttagggaaagtagcatgttgtatgatgttatatatccttctagtatgctaagacctgagatcttgcagggtacatatagaactagagatcaacgcggtgaaccattggcaacaacgtatcattccaggttccttggaactgttgattatatatggtaagtctgttgtgcttatgaaatccgaatcattaatcagagctttcaattatatatggctatcaatgttgtgatatatgcacatgtaattttgaaatctcaataattaatctgaggttttgaacccaggcataccaaggaactcgttcctgtgagggttcttgagaccttgccagcagatgtattgagaagaacaggtggactacctagtgaggtaagtttttttttctaggctaaactttttttctggggcaaccctttactttctcgagttactctattcattttttcaagaatgtaaaaactgggattattggaagagttgcatacaagtctctgaccaatgaaaatttgcagaattggggaagcgaccatctcgctatcgcatgtgaactcggctttgtcaatgactggcaatgagccaaaatgttagcaccaaccactaaaccgagccacctgacttggccatcccttgaggtttttgaatgctcatcgaggcttctgaattggagttcggaaacagattcagtaaattgtaaaacataaacaagttttgggctcattcccatacatagatttgcttacttgaaacatttttttttaccttacctacccaagacttgcacctactctttctgcttttaaaaagttaataccaaaatagcatgttactggacgtgtacctatgaggagcgaagacccattttgctactagaagcaaaacaatgtaagagacgttgcgtaaaaagtatctcaatctgttcactccaaaataagctcttctcaagtgtcatctgacgctgcattaatcaaaataccacacggtattatcaaaagtgtcgtaagcattctttccaagtgttgggaatacattgggtacacaaatcggccatttacagttaacacacatctatttaaatcactcttttctctttgctccaccaaaacattccggcataaacaaaaaaaagtcccactagaaaagctcatt

SEQ ID NO: 266 - DNA, 3000 bp, Arabidopsis thaliana
aggtggtggagcaacagaggaggaatcactaggcgcctctcctatataccgaaaacattctcgtaagttccaagaaaccaatttgatctcacagaggagaggacaaagtagaagtgttgtttacgtaccagggaaggaggaggagcaagtggatgaattggctggaatgttgcaaagcggaggcaattgtagagcaagagtttgattaattggaaaagcaggggacaaagtagaggtgttgttgaggaagagacagagacaggttgcttcttggctatagatctggtttaagctgtcacaacatggctgagccggaagttgggcaaagccttgaacgaatggaccacatggagctaaggaaagcagtctggaggcacatgtagctggtacttgagcgagaaccattcggagaaagaatgctgataaggagattaaaagagtgatgagaagagtagaagaagccatttttttcctaggagactaagtttctttcttctttgtttgtgggagagtaaggggattctgagtatttaaggttggaatcaattggtttggtgtgtgtgactatggacatgaattgttattgcacacatgatgtgtgtttatttgttgcaacacttgagttcttcatgctcgtttcttatttggtgtttttgagttcattcgtaaattgtgcttcttgttgaccacaagaaaacaagaatgttaccggaatctcgttaacaaatttttagaatttgaaatagttaaccaattgaaataccaaatttagaaaacttgagcaacaaagtcgttgtagtatagtggtaagtattcccgcctgtcacgcgggtgacccgggttcgatccccggcaacggcgtatttttaattttttcatatttgtttttattttagtccctttgttttcagtttctttagttttagtccctcatatttcaggtttgtttgttttagtccttctcttctttatattcaacttcccaatccgagacaaagtgaaatcacttaaatagtttactttccggttccgttcttaaaccttccgacgaagctccggtagagaaaacctctcttcacctctcccattctcggcagccatgtacggtggaggtaggttttattttcgtcctctctaaaatctctctctgattgtacaaattcagcattacttctttcccttttcgcttgagctcgtctcgtaaaggtgtaaacttttccttggtggggtttcttatatattgaacagacgaagtgtcagctatcgtagtagacttaggttctcacacttgcaaagctggttacgccggagaagatgcccctaaagctgttttcccttccgtaagtctcattctttacttcctctcttttcaattggttaaagttaggtccttttagtgtagagcaagcaattcgagaaatttaggttttttgttgttgctgttgttgatgtgttatataacttataaggttgttggagcgatagatggaaatggaatggatattgatgatgctgcaaacaccacggaggatgcaaaggagtctgataaagaaaaaggcaaaaggaagctttacacaggatctcaagctttgaactttcgccgcgatcaaatggaggtcagttttctttattaaacttcaaaatggttagggatgaagataaattttcaggtctctctattagttgacatttgtctgttccagatattgtcacctacaaaggatggcattgtaactgattgggatatggtggacaatgtatgggatcatgcttttaggtaatttgcagaatctgttagtttttgtctttaactgtttaatctttatcttttccatttatagttgattgatgatttcatctgtgtaaatgtttattattcaaggaattgtctaatgattgatcccacggagcacccaatgctacttgcagagcctcctctgaactcacagcagcagagagaaaagtctggtttctctaccttttatcgatgctgagttcatcttggattaggaacagattattctggtggaacatcatcaatgcagtaattgaaagaacgcctcgagaaagacttggtagaagtaaggtagtatactggcatcgttaggctcattccagcaaatgtggttctccaagtctgagtaagtaacacattggattgctctctagatctcgactcacgtataaacagtgtcttctcatcgctagggtttgagtctttttgtgtacatgacaggtatgcagagcatggagcttcttacatccagaggaaatgcccttaaaagctgcttgagatcaagataacgagaacctttggagacagtcagagggtttagggattaagtaattagtatcttttcatttatttaggcaaatattaaacacttttttattattattatgaagctttagaaatagcttcgtataatataatgtttcaacgttaacatacaacaaatgtactatttttctaagtgaaaacaaccacaaatgtacttgtgtgtttgcctgtttggtaaatccaccttctccgttatccaaaagtcgaatttacgtgtcgtagtttttgtcacattcgtcattatccaataacacatgtccacgtgtcaccattttctggtctctggacggcaagaatcgccgacgtgcccctatttaatcggattctcccatttttattttattttcgtcagattctctccaattttgttttttctttttagatttttgattctcgaatcgcggctcctgtgggtctctgtgttttccttattttgagttcggattaaatctcgatcgcgatttggtccaatatctcctagcatcgagagatttctattctggctaaattttgtgttttctcaggtggataagaaattttctctttgtcgttttcctcgataattttcggattacggcgacgaatcagattgttttttggtttcaaattttctgatatttccaaaaaaacaaaaaaatctgatttttgagaaaaaagca

SEQ ID NO: 267 - DNA, 3000 bp, Arabidopsis thaliana
tactagaatcgtaaaacgtatggattattttacattagttgtgttgaaacaacaaccaaaactcacattttgaagattccctcgttgtcgcctaatatattttgggcaaaatatccattccatgtcggcaacgtgtgccctactagttaacaacacttggcgtttgatccattccatgtcggcgtgagagatggtgagatggcgaaagctgatacgttgatcaatagtattattttaaagtacgtatacagatatactgttttaaagagttagtttcgtggtgatacagactgacaggtacgttaagttcgacttaacgtaataacaaataaaaagaataacaggttgttttgtttggtctacaagactacaagactacaagactacaagtctacaacgaacaagactttttataacataagtaagactttaaagtaatcaacatagatgcctaagatgatttgatttacttggccgtcttactagtcactggttagtggttacccagtttcttaaaaaaaatgttattattctgattaattaagcagatattttttttttcttttttaatagatatacagataaacgcatttatcatatttcataataaagtaaaaacgattatgatcggacatacaagcgaagtaagtaagtgtgattattaacaaacaaagagttgattgaaaattcaattgtggctgtaaataatatgtcagtataaaacatatcaatttttaactcattatttttaagggttaatatgttaagtgatcaaaacaaataatttaatatttcttattgatcgataaattaacccttactatttttagaattttttactttttattttcaaatctaataatcataggaaaaaaaaataacacacaaaacaacaaaaaatttccaaacatagatcgactaaagaaatttccccctcataaatttcttccgcatgtacttgataattacagcttttattctttaaaaccattttggcatttttgaatggctacttaagtgtggtatcttccgttccaccttatataactgtcttgcttcgtgctccattcatttcatagtgtacttattccataaagatgactttacacttaattcttatcatagttaataagcacttaattctttttctaatgtgtcatgaacacatgtgcacggtaattcgataaagccagtatgctaaagtgtaaaggcacttgtctattcttaagcaataaatcactgaaaacaatatttatcggacaaaaaatcagatgtaatagatcatttatgtttaaatcagtcaaattcaagcatattaaagggtgaagttttatgaagaaaaaattcaactaaaaaaacaaaatgacacttacacagttacactgacataactaaccaaatctaaaatttataaatttgtcacatcgtttaatcgttatctgtagctttattgccttttatctatgtcatctacatagatggagtagtaagctgagaagagaaggagaaatttaaggtcaaagttacccatcttccgacatgcacgtggacggccgaaagttcacgagaatcttagattattccacagtgacacatgtcggcctttgcgtgaggaagttttttggtctctaatttttttttttttgaaatataaaaggagataaaaataaatacgtaattaattatacattttaatattaccgttaaattattcgttataatctcctatattgaaatttgaaaacaaaactttattaactataagcatgataaatatataaccgtttatgataattctgatagtatacgtagtttttttttttttttttggtgagattgtttatgaaattagcaaggtttgacctatcatcaaaccttttacctcatgcaactaattaatgggtgatttcttttttcaaaattgtttttaataataataactaattagtaattagtgggtattttaaataccattatgccatttagctaaggtaaaaaatcaattgttaattataacacccaccaccaacatagattcgtctatggttcattcatcgtgtttaagagttgaaagaaataaattcgcccatcgtgaataatagatatttattcatctcaaacttataactcaaatatatttcaactatatatcgatcaaatagtatagcttttggttaatgacgaatttttattcttttgatccataattcttcttcttcttttttttctgtccggatacatgaaattgatgatacacatttaaaacaacaattcgaatcagggaacaaattacagccacaaccagtgatgatagaccatatatatgatttagtttatttaataaataatgtgtaagcaaatttggctttgctgtaaaaaaagaacacgaattttggcaaaagtttctgttaggaatctggttctattctcctctgcaacctccagtctctcatgaatctggttcggattctctttttccttgtttctatataatttagatacatggttttataattctatcatatgtctattttggatatagtattttaaaaatatatatatttttcataaatggttatggtctattctatgttaatgataatcattagtctttttgtcaactatgtttttttttccaacaaatttagtatgtaaacttttttttactaccgttttattaaatcgacggttgatcagatcaactccggtataacacaacataagtttcgttatcaaaacaaaaacaaaaacagatttttttttgtcaactaccagtgaagattagtcttacgtgtcaagaaaccggataaaaatatataacgtatttgggcaatcagctaagatattaactaacgcggagttcattattaaaatggagtaatgatgttttcagttttctatataaatcacgtcgagaccgtagagtcttacacaacaatccttcttacatttctaccaacaaaacacaaaacacaaacatagcattcaaaactttgaaaa

SEQ ID NO: 268 - DNA, 3000 bp, Arabidopsis thaliana
caataatagttaaaatacatatatagataatcataatcgtacacataaatattcgtttgctttctttttttgttttgcacgtcggccaaattgttaattttgcatgatccatagaagaaaccatgggccagattacgacactacgttcttcgaattctctttgtggttaaggaacgtgatccaatatattcagcatttatacaagaatttcaaaactagtagtaagagaaagaattgcttcttctttataaaggtttatagtatctaaattgtttaaatattcattttaattgtaaaaaactattgttaaatcattttcacatagtttttagtagtacatcatttgccatcatttttggttggtgacaaaaatggtatcatggcaaacgactagcagaagaagaatattaccgattataatcatttactgccgtgtgaaattgtttattcgtagcgtacgtaatctagataacggatcctgttaaaaagtgatggagattggacaagagttggagcttgaaagacgtacgtatattgataattgacatgagtttggacaattgttatataggcttatactgtttggctcttagcctcacaagcgaaattttttgggctagaattatagaggaagacgcgtgtgtcccataacttttcatatagaagaaaacttctgaagatatgttttttgtgaattactatcaaccacaacatgttagttatataaaaaaaaaaaaaaaaaacgaaaaaaaacatgcgtgtctaagatttacatgtgttatacactactacaagtaattggattcagtattagcgaaagtaacaactttataagagactgtcgtcatgagtccgatacatgattactaagaaaaacgaattgattaagaaaaagttaagtataaatatgggatacatgatttcactatgtgtgtggtaccgatagtattagatctaagactaattcgtgtagcttgcctatgtatataaatattatgtgtgaaccatttgatcatttagatgaaatatctgtggactgtggtagactcttcatcaaataatagattcaagttatttgatgtgcagaaaactcttcatcaaataacagattcatctttgaattagtcggacacttggccgaagactcagatttctagtgctaaaatctaaaaaacatatggattacatgattatagatttttgtatatataaatgaatacttcatcattacccgcacatatagattactaggaaacaaaactagtaagcgttacgtaatattttaaagagaactaaataaataactgaaacttgtgcgaaagactaattagactcgacactcgaggcatttagatggacccttggacctttaaaaagatttataaataaaaaactttgggaggcaactgaccttttagtgattaccgtgggatctaccaatgactatagaaaattaaaattaagaataaactgatgaaaacaaaagacaaaacacaagtgctcgtctctaaatacactgaaattctccatatctataaaataaacatttccttgtaaatatatggacgattgttattattactaaatagagcaaatgtcacatattgtgtcaaaatcatatgaaatttggacttaacgataacaaattaaaaaactaatgatgataaagaaatgttgtggcgccgcgtatgaattaggaatatattgataagtttcatggagatattgccaagtaaacttgctttgttgtccaaaaacctttgtgttgttcacgttcacgaagctctctcagccgccaatttttaaattacccaaaataccccaccaccatagagttaatccactgcgccacaccctgattcttttagcctgcaccaccacacgtcatcacgtggcgccatgtggttggaaaaatttagttaaaaacatgaataataatataaagtaaacctaaaggcatctccatcaaggagaaaccttttggtttctcaaacaaaaaaaatattagtattttactaaatttttattatataattaaatttttattttaatgaaaaaattgaaccaattgagataagagaaatataatgatggcttgtagagagtatctcatagtttctcacttgagaaactttctacactctctctctcttctctttttattatttttattatattagtagtgagaaactcttttgagagattaccaatggagatgatctaagtattttataaaaggttcttatccaaaaaaaaaagtattttataaaaggttcagaaaaatacaaaatgaatcttaacttataactattttacaattcggccatataatttgttaaaacttctaaccttaacaaattttactgagtaaagtgcaaatgattttacaaagaattaaaaacaattttgccacaaattttagtttgaaattagtgctattgcgatgagtttttgaatttttgatactaagaataattaaggtatataataaacactttacagacaaaaaatatcaaataaataaccacaacagatttctgatacatttctatataggcacaataccatatacattataatctttgtattttagtcataagtaacacaaaataaattgtttacatggtagttggcaatcatttgctaagaacaaccgacaacaaaataatcacacaagacaaaatgcagacaattctcaaatccacaaaaaaaaaactatagacgttatctattgataattggaatctttaacataaaccactatgattaggacttaaatgttagttttaacaacttgggtattattacttgatgattacaaagattaaggacttatttgactattttgacaagttgtcctacgctcttaaaaacccgttcgcttcctcacagtagaatctctccacaccggattatccaatattctccacgtccgcttcttccttcaactgagtccgactaagttgactcgttctctcgtgttttcgatagacacaaact

SEQ ID NO: 269 - DNA, 3000 bp, Arabidopsis thaliana
acaatttaagggatctggaaagcccctgttgtatctcttgcatggtcttaatactgacagcagtaacttctcaaaacctgccagctttgaggttttgacatttcatcctttcttcttcactttctctggagatttggtcttatgtttgtcttgtcttgatgctgaagatgaattatcttaccgcatgtcttgtgatctagaatttcaggattctgatgctcgtactgttttcctgatatttggaatctcatttgtaattatttctttttactgttgtcctgtcttatttcaggggatagacaagtttgagactgatttgactactttacatcctattttggcggaatgtcgagttattaaatcaagtttggagcttcaactaatacagtttgcaaatgatataagttctgaagctcatatagaggtgtgaatttgatttcctaacatgttttctctcgaattgttgtttgtctttttaaatggtatgcttagaccaatgaatgaaataaattgatgaaacgattttcttatctgttggcttgttcacaatctgtcgtttttgtatcatcttacgacttaggtttctgacctcaattcttcttatccactccatgtagacagtttttttcttctctttttgcaattctcttacatctttccaactttaaccatgtgttttttaatccacattaaggttatgaggaaagtcacaccgggcatgaaagaatatcagatggaaagtatgtttttgcatcacagctacatgtacggtggctgtaggcattgctcgtacacatgcatttgtgcaacaggggataataggtaagtttggtggataaatcttgttattgctgaatatgcagaaatattccttttcaggtgtttgtactgaaaaactaacaaaacgatgttaaattgtttgtagtgctgttcttcattatgggcatgctgcggctccaaatgatagggtaaagggaacacacattcctcgcttttttagttctctcattattccctgtttgaaaatgttttaatacttgttgcagacttttgaagatggagatttggcattgcttgatatgggtgctgaataccatttttatgggtctgacataacatgctcattccccgtgagttcttctagcatcaaatctattcttaattttcctctgaattgtctttgcaccgcattgacttgtgtttttaatcttgtttacatgaacatcataatttgctgaatgtagttatctagagaaagtggtctctaatatttatcaattggtgtgcaggtcaatggtaaatttacaagtgaccagagtctaatctacaatgtaagtgccttacaagattggtgcaacgtggatgtattagaaatgtgtgctctattttttgtcttcgcacaatccagagtttggtgagtctcttgaagctttacatctgaataagtttctctgattttgccttcctttcaggctgttctggatgcacataattctgtaatctctgcgatgaagccaggagtaaactgggtggatatgcacaagtaagtcttactgagatgctatatagctctgttctactatgcatgcagatgcagtaattgggattgacaatgtaagcgtaaactcagttgctttggtccattttgatttatcctcttgttagggagataaattgaaatacatctccatatggttattcagctttctttgtcgactgaagcaaattaatgtacaggttagctgaaaaaatcatccttgagtcactgaagaaggggtccatactcactgggtaattctctctgtgttagacatttcaatactcttctctaaaggttaattcattctcatggtttcgttctctgttcctagtgatgtagatgacatgatggtacagcgcttgggtgctgttttcatgcctcatggactaggtcacttcatgggcatcgacactcacgatactggtggctacccaaaggtacatcaaatcttttttcaacccaatagtatcatcacgtaaataaaaccacagtccctgtgtcttacccgttgctttgatctttcattcttttagggagtggagagaccaaagaaacctggattgaagtcattacgaactgcaagagacctacttgaaggaatggtaagggccgattgtttcaagtagaaatgcttttggttcttctcatttatcgtctctgttcattgtcctaatcgtatttatgtcaggtaataacggtggaaccaggatgctatttcatcaaggcattgctgttcccagccatggcaaacgcaacaacctctaagttcttcaaccgtgaaacaatagagagattcagaaatttcggaggtgtcagaatcgaaagcgatttggtaatgtcaaattcatattcactacaacgtctacaagttaaaacactctcaagagtaatgtcatatacaataatctcattttgttgtatatgtgtgatttcttttttaggtcgttactgctaatggctgcaagaacatgacgaatgttccacgagagacatgggagatcgaagctgtgatggctggagggccttggccaccgaccaagtgatcgtagctactcttaggcagcttatggaaattaaaaacttgataagtaaaactcaataatacaacctttatttttgttaatgggaataaggaaaaattgcctgtgttttactaatcttgtacatgtagtttattttgtttcagtgtcttgtttgtgtggttggatattaaaccgattgaatgttcaagtggacagataaaatctaaccggtttggtgcttgtcgacgaaaaccgaaccggtacagaaaatatcttgagcacaattttagttctaatataaaattcattaacaagagagaaaaaaaaaacttcaaattaaaagcttcgtgtcttcataaaaccctaatctcgcgacttcgtctctatccccaaaaaccctttcctctcttccttcttgtgtgagaccgagaaaaaaag

SEQ ID NO: 270 - DNA, 3000 bp, Arabidopsis thaliana
ttaccttatgtattagcctatggatttgatattttaaaactgccttttctttgtctccctctttgtcaggatgattgctacaaactatgttggtccattctttttgaccaaacttcttctaccacttctgaaaaacagcaatgttccttcacgggtcgttaacgttacatctttcacacatcattcaggtaagatgtagtgatatataagatttaacaagaaccattaaagactagcttaagtgacttgatatctctttgttttctgtagcttttattcaaaagctagacaaggattctgttactggagtgtgtttttcgacatcaaaccaatatccatgcgctcgaatctacgagtattctaaatgtaagccgatatatttctcacagtcacttaattacgaaacatatatagtttcttcatactaaattttgcttcatgttcttgaccagtatgtcttctactgttctcatatgaattgcaccgacaacttcggctcatagacgactcaagccatgtctctgtaatgtatgcaacaaaacactcgttgctctctcactgattaaaagatcgtgtgttttgacttgtgagtattggttgttgattgtagagctgctgatccaggatttgtgaaaacgaatataatgcgtgagcttccttgttacataacttccatggtgtttcttggcttcaaaattcttggcctcctgcaatccccagaggatggagctgaatctatcatcgatgccgctttatccacacccgtaatatgaatgaataatgaattttattgattctctcttcttcatatatgatctgattttcttacttacacatactaaaaacatgttattgatttgcaggaaacatcaggtgcttactattttggaggaaaaggaaggaccattgaatcatcacaagtttctagagaccctaaacttgctaaacaactctgggaaacatcttgtgatttgttcaatgacttgcagcttcttcatcaccacaactaattattaaagactctagaagatccttttatgtttatctaagaatagagtcaatttcatgaatatgagaaactatatgaaagaaatgtattgaagttttatagatgatatctttgttttattgtattaaatattgctatacaattacatttaccattctaagaaaacgtaaaatcacacatcgatagaccaaacttgtatgtaaaatggcaattgtatgttaacacatgtaaaatggcaatcgttagtatgccagattacttttaatagtattgttttaggtgaagggagactaatatatttttattttgtttgttttgagtactgattttgaaaaaaaagtgtatgttgattggttacttttctacacattcaaaactttataagaccagacgaaggcacgaggaagataaccgagtgtatgttgattggttacttttcacttttacacattcaatatttttctataagaccaaacgaagtcacgggaagataacaaggtcatgatgaaaaaaaaaaaaaaaaaaaaaaggaagataacaaggtcattttagtcatttaaataagactaaacgaaggtcgtctagtaaaacagaatttgattctctgggacccactattgcacaacacagctcatgtactacgcacctgtctttttcttgtaagtatcgaattcttgaacgtgtcgtctcacacaacacacgtgtagtattttaattagctgcagtttttgtgtggcttagcctatctcggagatctaaacgtattattaaatctttaaatacattttgacaaaaacaattaattaccaacaaataaagctctcttatctttttcgtggtcagaaatcgtcgagtatcaaagactttaacgtggctgcttcgaataatccacgtgtcaccttaagattcgttgataaaataaatgatttattgacaaaaatagcatacacaaaaagatttattgctgtaaatggatttgtggccaagaatcgtcgcgaatctcgcacctataatattctcacataaagaaggggtaaggctattttagtaaaagatactaaaagggtaaaaacgtaatttagtcggagccctaatagcctcacaacgtatctgggctggacactatataaacaattccctccaccttcttctctacaatatcacaaactcgtttgctcttttcatcattactaaatcataagcggctctcaagttctttagggtttcgagttttctcaatctcctacctgattaaggtttgtttctcatagcttttagagagatttgttcttttgttatcgttgtagatctgagattatgttgttttttgatcagctgattaatctggcgtttgttggttcgttttcaggttaatttcttatcttggatcaataacaagagaattataactccggattgtaatcaatattcctctacatgtaagtctctaatcatgaacgtgttattatgtttttcaattatcaatttttagggtttgattattagcaatttgttcttccattacatagatctgataatgacatatctggatttgttggaaaaagttgtatatgtaataatttgtttgaaactgcagaatcgttgaatttctatgtgtttatgatgctctagttatgtttgcattacatagtatatgattatctaacttttggttatatggttttgttaaaacagaaaaagcgtgaatgagattatgatggaatcgaaagctggtaataagaagtcaagcagcaatagttccttatgttacgaagcaccccttggttacagcattgaagacgttcgtcctttcggtggaatcaagaaattcaaatcttctgtctactccaactgcgctaagaggccttcctgagtactagccagttccctccatagcttttcaattacaacaatctccttttctcaaagctctggttccccaaatcctctcgtcttttgtttgccctcacaacaacaacaacaacgcagag

SEQ ID NO: 271 - DNA, 3000 bp, Arabidopsis thaliana
agtgcaaagctgttagaaagagctgtacaaaaaagatgagaataaaattttttataacgtttttaatagtttttgtgattgataactgttaaagtttgaacaaaactgtactatgttaccattcaaaccctatgactttcacaaatgtagtaaatcttcacacagttcaacgtaattttaaaatttcacaagcttttgacatgtagacttcaataaaaaaaaaagaatgttttggtgtaggtctgtatgatgagacatttaatccctaatgtagataaaaagtataccaggaaatgattgcaaggcagaaactattgtggccgttgaaagaattcacgtggcatgatgattcttttgtgtcgatcccatcttaattatggtgagcgtttggggataggattccgttagcagcctttaataattaagttcatgttctcaaggaacaacagatccagattaaatatttttcatcatgattttagcgcaaaaaaaataaaaaaatcaggaatctgttttaaaattcactaattgtttttaaaggaactgaactgtcctggtaattaattaatggtgcttggttgttctttagaaaaaaaaaattttttctaaagacgacgagaagtaaaatgatagaatccttaaacaaaaagaacaaaaaaaggtaaaatgataatgattaggttatatattcctcatgcacgacatcttcctacatgttttttacgtcgcagttctaagcatttcatttctctattgattattacattattgggtaattcattttgaaattgagaagttccttttctgcaaaccctaattgatgataatgtcacgataaaatttgaacttttttctatctttcgatgaagtggatagtacttgctctatgtctctgtagatatcggtcacgttgtgggtggagacaagtttgattcgttgcacgtgaagtcggtaaccagtacgaatagaatcaattatagattttttagtgtaggcatttgtggattttttaaaaatgttatttttacctatttgctatttttaagatacttaaaaatgtatttatttacgattagtttttacaataatatatattttatactaaatattatatttcaaaaataaatgaaaccgattaaacataaatataacgaataaaatacatattaaatcatatttttatatttttaaaagaagcaaaattcataaattcttttaaaaatcaaaatccactgatgccattaaaaatttgataaatccgtaattgattctttattaaggcaacataaaatttgatgtgcatgcaaatcaagtctaagatatcgtttgagctatcgttcaaaaaacttgaccaacaaaaaaattactaaaacttatttttattattataaaacaagctagcaaaacatttgagattaagttgtaatatctgcatcagaaaaaatggcatatccacacatgcatgtgaacatgtgagatttctctttgtcttctatttaattatacaacatgtaacataatttttccaaaatattatgtgaaacatagtataatctgatttcactgcgaaataaacgaagtgacttgcatatatcaccaccaaaatctttacaatattagttgtgacgaaaaagtaaacaaacattaaaagaaagtagtgtcgacatcatcattcatcatatatgtggataaaaatatctgaagagtcaggatctcgtgatcacgaactcaagaatatgatgcgtttacctcaaatctcaattaatcaaattttttttttccctaacacacaaaaactacattatgagattttttttcaaaaaacactattatgggaatttgcttaattgttttcttttggactaaatgtactagacgctgactgatcagtagaaagctgttaactaccttagccatgtggcgcttattaaactacaacagctagcagtgaaacctaataagaacaaaacgtgttcgattttggtttggcgatactttgtctcattataaaattgcatgttttataaataaagatcaaataaaatatggtgattatatatatatatatatatatatatatattgctgaaacaaatccgtgcataatatatcgcaagtcttaataaacttaaaaaaaaaaaaattgtttatagaataacaaataactaacactaggattgtttttgttttttttaccgtcatagttttatcatactttttccttttgcaaagtttcaataatattaaattgtaaatggttcaaaccaaaaaagtgtaaaaacaaagaagcaagcatgtgaatgtgaattgttgggaaaaaaaaaggagatttatatactcatgtttcaaactcccattaccttgcaccaagatgatataaaagagcactatacaagatttctatcttacaaacatgggcttccgaaatttaatgatattaggaggcagtaatatttttctatatagatctaaagatgctataagtaaagtttctctattttagaattcaccatcttatgtgttgcatgcatgatgcattgcatatagttaaatccattaacgcgtcatagacaataatagatcattggccctcaagttcttctcttcagcagtaaagttcgacttcactttcttacaagaggttagtatatggaccagtggaccaaacaaagaaaacatttgattaattaccaaaaacaaatatctcaatattcttttgtcagcatgatcaaattggaagggaccacgtggcgcttgatgggaacgctccaacgccaaataaccaaaagatatccaaaggaagccaacaaggaagtatagtggaactcgcactcaatggtttcgactcggacacacacaatatctgattttacttttcttttttttttaattgcaagtttgccactataaaatcagtccatacccttagttaacaacccacattcactctcatttccatcaaaattataacttcattttacattttgattaatatcctaaa

SEQ ID NO: 272 - DNA, 3000 bp, Arabidopsis thaliana
attatagggcaatagataagactctctaaaaaggaagatggctaatgaatattaaatcatcttgtatttatatcccttattgaccgatccgtatttaggtcatgaggtcgtgtttacatcgccttcagcaaatgaatcttttttctagattctctttatttttatgttttattaacacgttcatttttattcacaactttgatcgtaaaatgcatgataatagataacaaactcgtaatatatcgaggagagtaagcagtatctataaatatttagttgtgtgcatggcgttaaaaggatgacgtatagatgatgacgcagaggagattcctctgaagagagttcgaactttaaactttaataaaacaaagcatgtggtacaaaactcgaaaggcatgatgagaccataggacgtccatgttttagcatctatatatcatttttccgtcaacccacctatagagaagtatacataaaattaaatgtatggtttaataatttggagatccattttctggttgatgttcaatgtatcaaatagtctttgataaagcatctgatatatttgatattccctctaaagaaacatcacataatcaaacttcaaactcaaaagaactccacatcaatatttttgttttgattaatggttagaaagtaatgactcagtcaattcagaatcctgaaacgtataaaccaatattgagttcgaacttccaattcttacgttgtatacattttggtgtataaaaaatgaaaggaatgcattttcagcctttaaatttatgcatagaatataataataagtttctaactaaaggtcaaatcatttaattgtatttaacatttttgacacaactattttatcttgcaagaaataaatatgtaaactggaaaagtagttgagaaaacaaaatagttatttttatgccatgagaaggatgtgtgtaaaataagttagaaaatgctctaagaaaagagaaacataaaaggatttttaagaagtcttacagttgacaatatgaaaactttagtaaaagtctaccataaaccgtaaaaaaaatgaaattttaattctggaagtaaatgtaatgcatgttgcctaaactcggacactatgtggtagattttgattggtcggaatatatgatctccgaaaagcaacaatgtcaaagctgcgtgaagaaaaaataagctagaaagtaaattatatacatgtacaataatggaaacatatgaataatattaaggagccaaaatcaaaaatgaccggcgatgattaaggtaataaaagtcaaagctcaacacaaccgacgcttttggcaggaaattcgaagacatatggtaagagtcccactttctcattattaatctcttttctttgtcaaaatttgcaacacaaaacacgtttagagtcaatgtcaacatcaggattcagcagtatggtatacggtttgaagagaagcgagaggtaagtgtctgtgtagcaaatgcttgaatctgcttcttggcatctacaaactacaaagtatcaaaaacatatgaataatcatataataaaatattaattgcaccatgccatcattggcttgagactcaagccttgagtgttagaatcataaatagttttgttacctttttggcatttggtgaaatccaacggtgtttgcaaacactaagagtcaagcaaactccaataacaaaaacataatgatccaagcagtgctgtagaaatagttacataaaagttcatacaaaagtttcatactatggtgacaaatgaaacctatagagacttaggctttattgggcccaatgtttgtgagctacgagcccaaatcaagtgaaagataatgaaactacaaaaaatgtaattaaataaagctctttgtagatttagctggacaaattttttaaaaaatcaatgaaagttaaaaaggacttgtggaaaatgtgacgcgagacatttctaccgacatctgagaagaagtgactgtatatccaataaggaaagagaaaggaattggatcttcgatggagcccacgagtgttcactacgcaccatggaattggttcatatggcccattaagagattaatgggcccaaatcagatggcgcgtgtatctcacggtgattcttcacccaggtaaattgctaatgcggtgtctatgttgtcaaatctgtcgttctcaatgagaaatctccatttttcacgtggttaattttcctgtttataattttttttttttttttaaagtagtatcacaataattaattggaaatgaagggcatggaattgaagttatctaacttccttttaaattttcagaaactgcaattttatttagattcaataatcttttaaaattaggttgtaattattagtgcctcatcagtagttagaaaagtaacaagaattgaaattttcgacttttaaaagtgtttctctttagtggttatggaaaatgagatctttgtagatagagattactccttctgataattcttcaatacagtgttatctacactgtttctttcccgtatggtttcagtatcttgttaaaatacattagcaaatgactttaataaattagcaaaaataagtatgacttagaaaaaaaaaggtgtgtattaaactaaaatgcaagaaagaggactagggaagtgtacaatgcacctcgtagcagggaataacatgttctgatttcccacaaaacaccgtagctagctagctgcttctagcgttttctccgtataaccgtttggtttaaatttctccggtacggtcccactttccagaactttcacggtttcaccaaacgccaatcaccaccgtctgttctcctacttacacgtgtacgtatcagatttcacgatcgtaacccatccaagcgcctatattaaccctgtttatcccgctaccgtaagtcctcatcagcaaacacaaacacacgactagataaactctaaatcctcacagcagatcacgtgctaatcac

SEQ ID NO: 273 - DNA, 3000 bp, Arabidopsis thaliana
cgtcaacggtgaactcccaccgaattgcgcctcacaatgatcgggtatcgacacaacactttccatatcagacttcgctagagaaaagaacccagctttaagatcatccaacgccgccggtaaaaacctacgagccgccgtgccatagtcatcaatgcaagttttgtacttctttaagtcttcacggtctttgatgttcttagagacggagatgagatagtttaacattttgttgactttgtttgaagtcgcatcgatagagatccacgcaagctctatcatgaaagaaaaaaataaacaaatatacattttagtattttgacgtaagttttattatgagggaatagtagacaatgacaaaatttgcttaaacattttttttttctggtaacaacaacttcaccgattaaaatttgcgttaaacatgtcaaatatagcaaagtcatttcgtcagttttccttttttgtacgaattattgttcgtgttttctgtttagtttttgaaattgttggtagattatccttatggaagaagaaaaaaaaaacgtaatctaagatttttttgatctcacctcgtaaatttgagttcttgcttctaggatcaagattgagagtagagacgcagaggcttggattaatgttaaatttgcagagttcttgtatgggcttaggttccgtagcataccgaattggttgagacgacaatgctacttggatttgcataaatacgacaaaaatagagaataatttcatcattgtttttatttgatagtgcattgaaaggttaataagaaaaccttagtggatactggatatatatatcattacgaagccattgacctgttttggtcaaagatcattataaggcaagatattatttacgttgacgaagaggccattaacacttgtgcatactactagcttttattgtctttcttattgtagttgaatgtgtttgactagatgtaaaaagtatatgactatttatctctatatataaatacttatcaaatttgatacatgtttattgttacacatttagcacaaccaaagcctatatattttatcttgtggtctttccctcaaaactattcccctccccctaatttcaaattggcaacaaattaatggttattcaaatcggagtaacagatcttttattcagagggatcatccccggatttagagggtaataacttcaaactatgtagataattacaggctggacacgtcaaagaatgcacattaaataggttacatgtatcgaagcaacaaaatgaaaagaaaacgttttggcataattttaattaagtcacacgtacaaacacatataaatagacatgtctagtaattcatcgcattatagtacatcttaatttaccaattagtactaataaatttataatttttgagagagagctgagaagatgattatggtaaagatgatgatgatgatgatggctatggtggtgggagttgcgatgggaaatattgtagataagacatgcaaacagacacctgactacactctctgtctttctctcctccgctccgatccacgtagctcctaggccgacaccgtcctcgtcgacaaaatcaaggttttcactctttttccgtagactcaatatgaataagacaatattttcgagatcacggggtttatttactaaatttaaagttaaaaatattagatttaatgttaaaatgtaaatgtttttttttttttgttgggaatgtaggcgcttggggccgaaacggtcgggcagatcaacgaggcctacaaaacaaaaccaatgctgaaaaagccattagacgagtgtagtatgagatacaaaacgatcgtagacgttgacgtccacactgccattatatctatcaaaggaaaccctaagttcgctgaaggggctgttgttgacgccggcgtggaagcttccatatgcgaaggagggtttaccaaaggccaatctccgttgaccagtttgactcagagaatggaaaagatttgcgatgtgaccagagccatcatccgaatgttgctctaattaatttacatcttatttaatatgatctaaaataataataaagctcgtaaccaatatcgaccatgcctctttaatccgaatgaatgatgtggatcaaatttgtataacgttacattaaccgggactggctttaagaaccggttattgaacacgggcaaaaattcggcacgaagtttctagaaccgaatcacgggatatacaaaacattcacgagccagatatcgactgccgagagaaacagcccccacaatatttaattaagttaaggtattttgaaattatttggtcgacgtcgggtatagtgtggactcatatataatggtattttttttgtcgtatatgtgaccgactactaaagtactcatacgccaaatctaaaccacacataccctcttctttctcttggtatcgtgcccaacaaccacatataaccaaaaggataaagtgtaacaaacaaaaactaaagaccaaacacagatccatgtattcaaaaaaattaggtagtatgattcaatcaatatatacctcatacctacatatatacattaatactcaaatccaagtttacatatagtctaaaatacatagagctagctgcttatatagtatgttatttctatcaaactccaaaccaaataaagtttgttgatcacgaagtcgttcacgggtgggaattagaataaccacgtagacctaataatcattaacctagttgatcacatcgatatatagcaaaattcatatgtgatgacacgtaaaaagcacatttgtcttggtggtttaaagaagaaaaacataattgttagtaatttgaaagcttttcatataacaaacttaaatagcaactactatataagtctagaaacagagctaccagtagcattcacaacacaaccacacacgtctttatttttatcacatatcaattttttctcaaatttcactatctccgacc

SEQ ID NO: 274 - DNA, 3000 bp, Arabidopsis thaliana
cagttgggtccatacaatgtcaatgtcaaatgttaccgacttggcaacaaccgtatcggctcagctttccccattgcagaatcttgaaacctctcttgatggctctggtcacaaaatatctgccccttgcgcagtactgtattgaattattgtgattgtcagatctttctgtctacatgtgtagactagaaatatcttcatgtgatatttatgggaaaccatgtcttgtcctttctgaaaatgatacaacataagaagagatgtaagagaaaatatcttctaataatttttatttcaaagagatatttaatttgttttggttacagataaactcgttagcttatatatctacacttatgttcacttatcacatcacaaagcagaaaaatatcttagcgacaatgacaaaccaaagctcaactgttactacacttgaatttctttagttttacaattaagtctagacgatgatactctttgaccattgagataaccacaaaaccaaatcagtttgccatatacagtctaccttcttgcattcacaacacagaaatatttctacacacgcgttaaacaagactacaaaatattagcttggccttaacccaattgaaaaaaaaaaaacacaatcactaagccctaacaaatttacacatctcatccatgaatgaataccaccaagttttaccattgtttcatagctcacaagtcacacgagatcatacgatttctaacccaaatcctagatttctaactataatgacagaaaatattgttcagaagccttagttagatatgttaaccaaattggtacaagcaacatttaaagaacagagaaagaaaaaggaaccaagaaaataaaaaagatgtgccagagattgggttctagaatatcctagatttttacaatgatgaaatctaaagccaaaacaaagaagcactaatcaaatgtagtcgaccaaataagtgaggagggtaaaaaagagaagtggggagggtaagcaagtaggttacgtggaaggaagatatcaacgcacaaaaagagaaacactcaacgttaagggaccaaccacaaatcttggatttttgctgatgcagtgtgtgaaaacaggtccacacgctttgtacttttttcatcatcggtctacaataaagctcaagtctttccatggacagagataagcaagaaaaagtattaacattgttcacctcaaaataatttaggaaaatgacaatgagatttttacctcaaaagccaaaatcaacatctacccattctttcactcgtcacaatcatgagtttcttacaatgcttaccttagagtttagagacatattctcacaaaaaaagcttgtgtctatttcaaattcttgaccgtagatgtcacaacatgcatatatcattgaaaacagagcaacacaggaaacaaagcatatgtatctagatatacttagcaagacataactatagtctttgaatcaacataaggattaatgatagagaatgaggaagctcaagattttatactcagtttcttacaaaacaaatttctctctaactgcaaaaacaccaattaggatttgaagagcgtacctgtttgagtcaatgtccaatgtcgtccccccgccttctacatttcttagcctgctgaataaaagcacaagccaaaatgagaaggtgccaaaggcgataaggatcaatttctaccattcaaaaaactaatggtgagaattagaaacgagagaaaactacttgttgaggaaatagccaaaagcgcaatcttcgtcacctgaataaagaccaaaccgtcactttcaatgagtcagcaagaaaaagagagagagagagagagagattctctataacatttgagtcgacatggattctaatgcatcaaaagtcatctccaataaacaaacacttgaaactcacatggctaatagaacaagatcaaagccttaagtattaagcattacagacactactggctaacttttgacacatgttcttaagtaacatagtatcaatatccgtgaatcacatcgaacacacacaacaagggcttaatgcatcaaagtcctgttatttccatataacaacatatttcatttacaaacagaatgcagcattcaggcagtccaaatggaaaggttgacaaaaaaatataatcttgtaactctacatatatggcagaatgtaataaccaggcaagaaaaaaacagaataaacagatcaatgagtatgatataaaaaaaagtcacaaagaatgtgccacagtgaacaagagggccatgagaagaaattttcaaagaaaatattagcattgttagaattttttgggtcaatggatctgtcagctgcttagttggaaaacacaaatcttacaggaaggaaagtccaagaaaaagaaaataagcaaagttaatagccaccacaagaaatttcatacagaaataattaaatcgttgcacttatcttcttattcaaactaaaatcaagagaacttaataattttcagccacacgaaccatgtgttcaaagccaaaggtgagaagccaaaattatcagcttatctccattaacaagagaaaagcaagactagatttaagagttctctgtaactaaaaactgcaggagtgagtaagtaaataattcaccaacaggaaaacaaaactcaattatctatagctgaatacacatgtaaatgagaatttattaactaaaacatcttcctttgtaactgatgtgacatttacaatttttcattttgaggtgtaagaaccgtgtgacaagtgaaaaggttaaaataagcaacctttgtgatattttctctccactttttgaaattgggtctccaaaccacagccaatcaatattctttataaatacaaacacacaaacagcatctttctctcaaacacaaacatatcttctatcaaacaccaacagctctattctctacctcatttctcatcataacaaagagagagaaaaaaact

SEQ ID NO: 275 - DNA, 3000 bp, Arabidopsis thaliana
tgaccaggagatctgtcaagagcatgcactttttctgtctagtttaattggaatttggagttgtgtcagtgtcttggcgcttttaacactgggaagtgaagtgttgcatccttataatgccatccttctttgttacttggataactggatttcgcttagatccttctatgtatgaagaggttcagcttttgttgctaacaactcgataacagatcattttatctgttgatgccagtaccgtctgtacgtcttttctcggttcctcagcacttcttctttgtttttttgtgcaggcttattgctccaccagttcaaaatatatctgtacaggctagagtcaacgcaaaggtaacttactcatgattatctgttaggttgcattagactagcttcttagtatctctcccttggacgagtattcgttttgatatgtttatgggggaccataagatgtgcattttagccttctgctgttctgcatccgtagctatatctgcctgttgatggtagggagtatctgaaaggtttatgaattgaatgtggttgtaaatctttatgggtttgtaaatcccagaccatggaatgtgataggggcttgatctggtaaatgcttggtgtgataactgaatcgaatatcactatatccaataactttatactgaatgtttggagggctaataacaattgatcttcttaatctgcagaggcatgaggtagatcagaaagtagaacacagaggagggaagaggaagacactggactctcgctttgcaagcatgaaagagcagagaatgacgattaacaactatggtgttacagtgcaagttccaagattaccaccatgggttagagccagaagattttcccaatgagaaaccacaaagcttttacgggttgttccagtttagaatttggcttttgggtttagaatcttgttaagcaaacactaagcaatgcaattcttttgtaaacatattgacttttagtatcatgaaagaattttttttgagtcttggttcattatatagtcgcatttccacatttctgtcaattacatgtttgcctctaagtgagtacgcgtcgtcaagaagaaagcctatcagccaagtatgtcttaactcttaaggaatgcttcctgtataatctagacaaatagagttgtaacatttaaatcttcaaaattgggggtgtagctcatatggtagagcgctcgcttcgcatgcgagaggcacggggttcgattccccgcacctccaattttgttttttgttatttctgtatcttccgttccttgtatatgtggcctcagttaattcaggcgaaagaaactcgcaactttctctgtttcctccattccactttttcgaagatgtaactaatttacttaaggaaaacaataaattatgatctttagtaaatatggcctattccaaaaactgaaccaaacaaaatatttatgtttgattttgagttaattacacattaaatttttaatcacacacccagaagcagctaaaagacttcgacctaactccatcatataattatcttttgaatttatcttgaagaccatatataattatggcccaaagactccaaactgactctttgtttttagtgtgacctaatcaatatcactttcatatgttgtccaaaaaaactatacgacatacaactcgttctcatattttacagtgtacacttaacactttggtcacacgtattacgtaccgacatatttatatgcatagcttgagtatggagactgcgtcaaaaacaataaattaactatatttaaagaaacttggcaatcatctagtataaaaatagtcgattttttttctcttgtcaatccacgttaattaatctatgctttattatcaagtgaattaaagaatttgacgtaaaactggtgtattcaatggattaacattgaagcttattcacaaagtggtcggctattgatttactccttagacttgctctaattttctttcttaagctttttaattttggtacgtcacttagtttgacaagcggagctgtttaagtgaaccacaatatattaattctctaaacgggttattgtacaatatattaaatcaaaggaagttacgatgaccaaattaactttcataagaaaggaaaacaaatattaatttggagtttcaagcaatattacatctatatacctttctattggtttcttataatgttcacgagaaatgtaggaaaactataaagtataaactgaaaacagagaaaaagttgataaaagaagaaaataaatatcacacatttcttggctcatcactcaagtcacggaaagtctttggagaagtgtagctaccatttttgttcattttattttggatagaaatttaacacacacttaatgatatggtttgaggaaatagcttatattaacttacctttccatgtatctatttatattttgcttaataataatgtaaacgcaataacatatattaaaacaaaggaaataaaatcttaatatatacctaaagttacacacaatcttagaatgctagcatactcaaatctcgtgaccccgaattttctggaaaaatcaattctacttcttctacctaaacagtttaggcttacaaatccatccaaatttatccattcgctttgttaaatcttaattgagcctaataaaataacatttgttaccaaaaaaagaagatcaactatataaatacacttccattaacaaaaacgtcaaagggtaattaagacaattcacaacattccggtatattcgcaaccaaaccaaatcctgccacgtagcaattatttcctcttcatttttctctctgtctccctcgaagaaacgtagaaatcagaaagtaaatcatacagtcaaaaccgcttcttctataaaaccctttttagctcaatcccaaaacgcaataaaaaacaaaacgctctccagaatttcgaaacttctaagatattttgttttctctcttaacg

SEQ ID NO: 276 - DNA, 3000 bp, Arabidopsis thaliana
gaacagagtcggaaaaatcgaactgtaaaagaaaaacactcaccgagacgacgaatgaatctggagatttgtggcttcagagagataagagaaatcggaagatatggttagttaggttgcttagttttgattttggtttaattcgatccacttgcactgataattcggggatgagccctaaaaagtctccgagtgttgttgttgttttgggctcttcaagattctgttgaccaaaaaataaaagattccatatttatcttcttccacatgtattcatcatcttatttttctttataaaaaaatctacgtaatagagattttcaactgatttacttcctcatattattttttattctgaatatagatattactataatttacaaaataaaaatatatcttgatcgtataattatttggtataaaatattatcttcccacgtaggtatataatttaccaaaaataagtttaagatggatttaccaagaatccaatattattacttgcgatactttatatgggaagtagaataattggatatgatattggaatttctttttggaaagtacatattgaaaatgttcattatcgtatgaagcagaacttaaagactggctgggatagttagtacttttgagaaatgggattatcgaatctttgaagataatctgatgttgtatgttccaaagagtctgtcgagttttgtatgcggaagctttcactgttgtaacactttgcaacacttgttctttataaaatggtaacacttatggggatatttaaaaaaacaaagatagcaacatgtttagcttttataaaaatgtattatttgaacgataccagggaatcaggatgctagatgcattatccggtcggtgaacgatcgtgacacccaagcaacaaatatacaagaccaaaattggccacgctctctcctctacccctccagctttacttgtccttatcacttccctttatcatctgaattaatttcatctcattgatgcttctctatgtataatgatccaacacaaataaatcaatcaaatcaaaccaaccgatcactttctctttttcactcataatcattccaagcatgattttaaaatgggcttttgttgtctctcataaaaggtgatagctattcgcctcttccactttcttcttagattgttgtagtataagtttaaacctacgactacgagtggataaaatggttttggtttgacttattaggtttaatcgagtacgacaagtggacttgtgacacttgtccaaccgatacttcttatcttgtgtttttgtgttttctcgtcttctagatcacgttttggcatattgaatttattatataagaataagattcgattgttgaatttttaataagtatggctttgttatattacacgtaagaattgaaaacattacttgatcaaagaaataaaagattttatgtgtggtgactgataatgttgttgaggaagatcagagtcattaatgcagactcagtgaccagtggacaatcttgtataaagaaagacattacagagttatattcaaaaacgtggaaaagtatgcattaccttcttgagatggaaatcttaacaaaaacaagcttttaaaattgagtgcatgtccaagtcatttttagatttggtgtttagtgcttcaatatttcacaatatccaaaaaactcataaaaagatttcagagatagaccaagaaaagttatttgagtctctaagaagggattgaccattattcttaattatactatttgatgtttcaactcacttccaatatgaaagtcttaaacataatcatattatagatattaacctgtgaataaaatgccaatcatccaactctcaaaaatataaatgggccgagaatgggctcacacagtaagggagagtaacgagagaggcttgaaggagaataaatgttacttcaccaaccggacctgccgacctctttcattctctgtttgactcactattccttcacacaaaaaagggaacatttaagtttttttacattttcattcaactttaattctgagagcatcaggtaacactgctccacaatctttcaaagattcctcctttttttgttgttctctctttttatttggcttacacgtccgcttgacctcacccacatgcccctgcctcacatcaaaccatctttatttcgtaatagctaaatcttagacaggcaaaatctatcaaattttagaaagtactattcaaaattaatactctctcatgttactaccatacttgctgattataataactgtaaactataacaaagatggtaaacccaaatctatatttatgattgattaattattttaaagtatatattgatgattttttctttataaattatcatgattgccgtatcgtataattaatagatttgagtggtattgtgaagagctactacagctaaggaagtagacaacacctaacgtagtaaattaaaacattaacgtttctcttttagtccctttttttttgttaatcgttttcataatattctgctaattaaatttcgattgggggtaccaatcaaaaagcaaacaccgcctttcaggtcactgggacagacaataaaaaaacctttttcgtttatgttccatgtctgaaattaaaacattttcaagtctcgtgtatttcagattctccatcttagttcttgtaacctctccctcttcttctccaaattccacctgagagaagagaacttattccacccaaaaagcaataatatatagtaccgtactttgattttttcgataatctgttgattgaagttaagccaaaactcagctctgttcttattcttcttcaaacccaagtttcccacttcactgattctttcatcttagctcgttttaaccacaaagttcagttcttttttggtgtgtttctttttcgttattggcttttgccttttttgggtatagggtgtttacgatttatctctcggttccg

SEQ ID NO: 277 - DNA, 3000 bp, Arabidopsis thaliana
aggaaaatggcacacttcttctaagattatgacaagaagtcgaaggaattaccaaatagcccaaagggcaatgccttactcgaagggtagtctcgagaaggtaattgtgtttttttcccctctcttcaaatcataaagaatttaaattgccgttaaattttgtctttcttttaaatgtttttgtttaatacagatgacacaaaatgtgaagaatctgttaagcaaagctcaaggcaatcaaactctccaaagcttgatcaatcattctcattctttgcttagatgattactgcatccctcctaaatgttaatttttttataaatagtttgaagaatgaatttaattgtatataatatttataccttcattgactctattaccaaataattcaattgatattgtttatattttgtcactaacaactttttatctgatttttacctcaaacttttatgaatacatcacattggtattgtttgtcatctttaaatatattttcttttgtcgtattatctacgacttattaatatttcaacgtaatagtttttaatatttttgtcgtatttattcatttctatttagttttggataagctcttgatcttattttataattaaatatttcaacgtaaaagtttgtccaacttataatcagttgtttttaatttaattttggataagtttctgatcaaatatttaattcttattctgtttaaattggaaacagtttatctgttattaatgtgaaacgaaacaatggataaactgttcccaattgacaaaaataattgattactttattaatgtgaaacgaaacaaagtttgtcaaaaacaaatatgaaacgaaacaaataaaatatatctacgttattgggaagaagaaaaaaaaatatctacatagttgcaattaaattatatattttaatacaactgttataattaagacaaaatatatatgtatatatatatatttactgcttaatatgttttgtttgtcgtattatctattattcgtttgtgaattttattttggatagtagtcttttcatttacttaaaattaaataattcgaaacaaaatagttggacataatcaagcgtacgagaaacttccagcacatcaacatcaccctttatacaaaatgatttttgagtgaaaaaaaatgaatgtgaaacaaagagaagtatgtggcgtggaggaacacagacaaagagtttacaaagggaaacaaattatcaatacacaaacgtacgtatggccacaaccatgcctatcaaactttttcaaagccattccatttccaaggtgtgtccaaaaaccattttttttttttttcatcctccataattagtttttggattcagtttttgaaacttcttatgtcgactagagcaagagcactatatttttatgtagtttttcaaaaattagcattgctgcaatgaataggtgatacgagagccaagatcacacgtttaacctttaacttacaaatcatcataattaacaacacaaagataaaaagagaatgatataaattcaacagataataagagatcttttttaacatgccacacccaaatctgaatataatgcaacatctttaaaagaaattgtattacaaatcagttcatattggtccactaatgaaatgattcattggaagaccgatgtctagaataattttcaaggcatgtgcaaaaagttggattttctttccatctaaacctttcaaatgactaatcattattgaaatagaaatgaaagaatcccggttacaaaaggaaatcaaattacatattttaggcatcatataaactagtgtaacttggaaaagctataacaaataatttaaatttttaacaaatgtttcaatttgtgttaaaatattcaaatttgaaagtaaaatgtaactgatattttccttatgacacattgctcgaccataatcaattaaataatatattcagaataacgtctttctaagacatgaaaaacacgtgaaacagagcagtagaaaaagtgtgaagatgttttacagacaatgataatcagtgttctagactaaatctttttgtttcatatagattcatagttatcaatgtctggttatgatacattactcaaatgtgaaatcacaagtatgaattaatattatatttaaggtattttaaatttcttagatatgtgtaaaaatatatttaaaacacaaatctttaaaaaaaaaaaaaacataggtaccttgaaatcatcggcattttgaccaattaattagtgcaagtatcaattaataacataaaaaatcgtaattaaaaaaaggtaattcacgtgtcaaacccagtcaacaagattccataggacccacttttaaacggcgacaaaaaagtctttaaacggtcgcacttttgttccaaacgaccgttaacaccgatattaactatctcacgcgccaaacgctacacgtgattcctacggcgaccaattgacagctaaacgtggttcgtgttgtgcactctctttccttcgtaactgacaaaacactatctttttagtaactgtaacggaacaaaaggtcccatgttgacgaaacactgtcgttttccaccaaattaacggaactaactaacgttccccacaaaaatgtgggacccatgaaacaaaaaaaccaaaccagactttgctatcatcataacaaagcgacgccacgtgtatggaccagatatctgacgtgtcaattactatttttaattttccgctcctccctcacgtgtgagaccccacacgtgtggctcactatgaaccagaagcatcactagctcacatgcattggacaaatagggaccatcaaccagtgaagtgacgccacggtgtctctatctcccttgctgtctcgtctatataaacttgcacgtctccgctgattagaagcacaaaactcacaccccaaaaccgatccaaattccgagaaagacaaccaaattttccttttcctctgcaaaa

SEQ ID NO: 278 - DNA, 3000 bp, Arabidopsis thaliana
atgcaatgggatggtaatccaaaaatcgtgttggatgtcaaaaccttacttggcgtgtctctacctattgaggtactccactagtaatgctattttttataaactttgttatccattttttgttcttgagcttactgtgttgtgtctgtaggtcaaaaacataggattcacaggtgttttcaggctgattttcaaacctcttgttgatgaattcccttgctttggggcactttcttattcactccgcgagaaggtaacttagtgatgatatgatatatattgcttgttataataacttagtaatcttctcttgttttctgtgagcagaaagggcttgattttaccctcaaagttataggtggtgaattaacatcaattccagggatttcagatgcaatcgaagtatgccaaaaaccaaatttgatcgtatgttttgacagcataatgttacctattattgattaacaatctttctttaacgcctttgacaggaaactattcgtgacgccattgaagacagtataacatggccagttaggaaaattatacctattttaccaggagattacaggtttttttgcttctttgtatgattttttttttggtaaagaccattttatgaagatctgaaaatgtgttttgacagtgatctggagttgaaacctgttggaaaattggatgtgaaggttgtgcaagcaaaggacttagctaacaaagacatgattggaaaatctgatccttacgctattgtattcattcgccctttgcctgacagaaccaaaaagaccaaaactattgtaagattttccctctaaacagattccactatctttctcttactgatttggattgtgcatacctctcttggtaattctttttaatgtcatttagagtaactcgttgaatccgatttggaatgaacattttgagttcattgtggaagatgtctcaactcaacatttgacagtaagagtctttgacgacgaaggagttggatcttctcagcttattggggctgctcaagtaccgttaaatgaactcgtacccgggaaagttaaagatatttggttgaagttagtcaaggatttagagatccaaagggatacaaaaaataggggtcaggttagtatttcctcctatcataactattgtttccatattcataacacaatgtagaaaaatataacatatccattttagttaggactataaaagatatatttgtggtgatataggtgcagttggagctcttatattgtcccttaggcaaagaaggcggattgaagaacccgtttaacccggactactcattgaccattttagagaaggtactgaagccggaaagcgaggattcggatgccacggatatgaaaaaactggtgacctcgaagaaaaaagatgtgatagtgagaggagtgttgtctgtgacagtggtggcagctgaagacttaccagctgtagattttatgggaaaagcagatgcatttgtggtaatcacattgaagaaatcagaaacgaaatccaagacaagggtagtaccggatagcttgaatccggtttggaaccagacgtttgattttgtagtggaagatgctttgcatgatctattgacgcttgaagtatgggaccatgacaaatttggcaaggacaagatagggagagtgataatgacattgacgcgagtgatgttagaaggagagtttcaagagtggtttgagttagatggagctaaatcagggaagctttgtgtccatcttaaatggactcctaggcttaagctcagagacgcctcttgatcattctatcttctactctcaacacattactttgcttattttttgttttttgttgtatagtgtgctgatgtttgttacttcttgtcaattgttatcctttcttccttgccttagaagaaaccaatataagtattaaatatacactttttctgtttatattcattttactcactttaccttcatttgattcgtaattgtgaatgaatttgtactgaactgatattggttttggccttcaggggtgaccttcttttccttttaaactctcctactttagatgatcataattagcagcagcatgaacaaatattgtcaaataaaggaaaagtaattattttgtgactgacatatttctgtattttttaattaataaaattaaaacactaatactaacgaatgacgtcaacatatttatgataatcaataaatgatagatactttaaaatgataatcaataatttaccgagtagttttctaccgacattcatattaaaagcttgtaagttgataatatctgattttgagggggttacgtgggttcgtggtcgtgaagattataataaaattgtagacagctgctcactgtattattattattttttgttaaagaacagaaaatttggtcagtgtgttataatattcgttcgtctaaataacttctttatgctcttttgattattctatatgctaattatggtctagagtttgccaaatgtcaatcactcactgcgcagctgcgcttgttatagtatcaattagtcgtttgagaagactcataccgaaaaattcataaacaaatcgttacgaatcttccagtgttacgtgactcgtcgtaattttgacacctcacgcttttttaatactaaacaattatgtttctaataataaagatatgacaaaatcggatattccctcagtaattaattcagatagtcaaatatctaattaagggtcatttaattgggttataaaaaagaaagaaaaggaagagacactttttcacaaatcgccaaatcacctctttccctctccttcttcttcgtctctctcgttcgttttctagaaacctgtcatcctcttccatctccagatcacaacactaactatcatcacttttgtatatccgattcctgattcaccagtttttgtagagagattggtttctgctttctccagatcgttgagttcgggagagcgaacacca

SEQ ID NO: 279 - DNA, 3000 bp, Arabidopsis thaliana
ccgaaaatcatatatccttcttctagatttttatggggtttttttttttttttttgctttgtttctgctttatttgactgaattcggtttctctcatacatctccttttttccataaaattattctttaatacaatcaacgcctatgattctcccgtctcacaaacactcaaggaacaacgacaaattttggcttctcatctgaacaattgccttaaaacaagggtgagtttaatatcttaatcaaagctcaagtgtttttttaatggtaaattaattctcatactttttactattcttctttcatcttttattttacttctttatatctgcaatttcttttttgtattaaaccgcaattgtattttcacgcaagatttttgtattaatacaaatacttcaattttaaagtcatctcttattttacttctttatatctacaatatctttgatattgtttcaaaggcagcgtctgcgtcatgtagttacttacttttgcacattttacattgtttttagacttccaagctttgggtgtcaacgaatgtttgtaaactgaattactgatgatgagaagaagaacacattacaattggttgtagctaatgatgaaataagcggacatgtatatacccagcataattttcgtacttatactctcttatatttctaaactcttgatttgttagttactgtctatcgcaattgattcattgggtagaaaagttataccttttttatatctttttcttaatctttgtatattcttcagttaatgataataaatttgttgtatatttatgctgtctgttttattttaaaaatcttagttaagagttgtagcaaatataatttaaaacaatgttgtctctgcatagcaggggccaaatgttagttaatttctaaaatatgagtaaaaaaagaagtcaaggttaatcaagaagttaggactagttaattgaactaaagaaaggaaaagaaaaaaagatttgttaaaactggaattaattattttcttgaaaaggtcaaaaaggaaaacgtgggatatatagttgcagcttattcatcaaacagttacaagttttttattaaaaattagcaaaaacaaaacaaaaaaaacaacacataacttttacaatttataatataaataaataaacttttgggttgaaaagttaatttaacattaatatttaaatattttgaattgcaaaatatttgagaattaataaaactttttttttgcatttattggaaattaaatataaccttaaactaatactttagatcattttcatatttagtcaaaattattcaacaaacttttattacaatgattcattttaattgtatcaaacaaaatttccatagagtcaaacttataatttatatgtttaaaagctgtatttttttttactttggttttaaatatgatatttgtgtgtaattaatttttcttgtttgtcaagtattattaagatagagagatattatttcatatcatcaaatgtaaatgtcttgttaatccaattatccaaagatcagtgacatatccgatatatctattctatttaaaggaaaaaaacatttagtgattgttttattataacatttaaggaaaatgtacactattcagaactttcctattttcctaaaacacccttttccttggacttttaaatccattatatttagtcttctgggtttggagcccaagaaataaaacgtagaaggaaacagagggaagtaaatgattcatatcagcttaccaaaatttgtatcaagctttaaaaattcgtctctctataaatctgaaacatattgaacattaacctccacatctcactcaaaaccacttctctatactccaggttcatttcttcttctttaatctttaaagtttggtttaaagtttttctgatacatttagtttaatcatttttcgttcttatgatagttaacgaaacaagtttttgtgtttatttttctgacaaaaaagcagaaaaataagatgaatcaaacaacatcttgttctttttcttagaaaattcttgcctgaaaaatctctggttagtaaaaaaacaccaaaacgtttttatattctaaagaatcagtcgtgatttgtattctattttatcgctttttaatttttttagaggaattttctcatagagaattttccagctgtgttgcagaaaacaaaagaatgtcacgtccaacattttctttaatttagtaaacattttcggaaaaattcttttgcattatgaaccattttctcccgataataaaactccaaataaggaatccactatagagacttttgactgttcaagaaactcaaaatatatgtttagttttccctttacaatcataatttcttttaatgtactgtatgacgtgtaccaggattcttattcttgtctttattttacatgtctgcatccaacttttttatatgtcacacacttggaattaaatttgacgaagatgttttgtaacttgtatggattcctaaacaccattcctttaaaatggatggtggataggaaacgtttaaccaaaaaactaatgaatttgatggataagattgttctttaaacatcaatttcattttgtaaaacaatgtcctatgtcggctagaaaatatattagtcaaaaacgaattttggtttcgccatgtgtacatgtagaggtcaagtacgtgaatataataacaacctctagctcttagctctactgctctaggcttgtttcgtaaaaccttggaagcttgaaggctaaaagcgtaaaagaaaagtcatgttttcaataaatttcttgacttttagttataatatcttgacctttgttataatatctaacccatagtttttctttatatataatgtgaatatggaaaacacaagacttcatcttatattcatcaatcttattcttattttctctctgcagttttcaaaaactttctcactgttatctgcgtctcttttttggatca

SEQ ID NO: 280 - DNA, 3000 bp, Arabidopsis thaliana
aatttaaacaattaaataattttttttattgaaaatttaattattttttaattaccctttaattaggtaggtgcagctactttttttcttttccttctttttctctgtgaagctactcgttgattgtactaaaaagtgtaaaataatactctgtttagtcggtgcaagaaatagaaatgtaactgcttcagacgaccgttggatttctttattcatcagttttttgattaagcgttggcttatttttaacaactccacgtgcaattctcttataaacaaatggttatccaaacgcaaattccttgaccaaatctttttggtcggtttgtttattacaaaaaaagaaatagacaagatcaagggaattagatagtacgtggcataatcccccgttggtcctttgaatgttcttacttagctctggagtgacaattcaaatcctttgcataagtcacctcactaacatctctggtcacatgaacgaactcttatttacaaagcagggtctctctcatcatttttttttaaatgacaatgcatatgtggtctctgttcggtcgattacatttgaccaagtgagtgttcatctttgtaatcatgttggcattcaatcccgagtctcttccatcatcataaactatatcaaacaaactaacaatgatcaagcattattttttctctcttttttctgggtttatattgatattgaaacacaattactaaaagtattatatattaaaaagattttttgtatttatcagttaaactaaaaacctaaaatgctcatttctttagttgaaatagtgtttaccagttgcaataaaaatataaaattaaaccaaagtttcaaggttttattttttaatgagttaatctttcgagattctataaattaatatttattagtttgtagatatatttacgcaaaatacagtactatgttatttttagattttttttttattaaaacttttttaggttttgttctttgcatatttagttatgttttttttacttctttaatttctttttctccaacatattatgttaacgtagatacgaggcttaattcaatttttctttacataaatctaagcaatgacttttcatctacaaagttttttaaaatcaactataactgatcaaatacgtaaagagttatgtgaatacaaaagaaatcatatcaattgtactcaaaaggagttataattgttgattgaacagaagttatatacaaaatttagtcacacaatctgaaacagactcaagcgatcagctgaatatctatcataaatgatgaaataaaaaaaattagagattaacttcaaaaaaattcaaacttaaaaaaaaaacaaataacattataatactaaatttttttaaaaatatatgtttaagatttatgattattaatttatgatattattaggagcatatttttatatagagatttcaaaaaaaaaattatcttattatctgatcgattttggttaatttttatatttacacagaaccgataaaatttattaatttatagaatattaatttagagtttctattgtataatactaaatattggaaaatctaaacctaaatctaaggcatttccttaaattaaatataacatgaaaatagccctagtagcatttataaatccaccgagaatcggcataatttttttgtacaatgaagttagttgagttaatgaacaaatttattatgaccaaaaaatggaaataaaatatcataattggttcaatttttttaattggttcaaaattcaatatataaaaattaaaatcttaattaaatcccagaatctcataaataattttgggtccgactagtgacctataaaggaatacaaggaatgaaaagaaacataactaaaaaggaacaaacaagaaaataaaaaaatgataaaataagaatgaagaggaatgggtgtggaagaaaaatagaacaaatgttactgtaaatgataaccaaaacatagaacaaatagtaacaaaaattaataaataaataatttattttctaaattaaatattaaatataagacgaaaataatttaatttttaattaataaatgtttaatttgtttttttgtctgtttctcatcaaatttgggaaggaataattttcttgtacgattcctcaaaaaataaggaatgattaggaatagtgtggggtacacatattacaatttagaaaaaaattattgctgaatggtgaaaaaagaaaaaaaacaataaggaacgtgttgttcctacccattcttttcttaaaaaatgttcaccaattggaccctttattttctctgaagaggaatctgacgatataagccaatcatcatctaatgcctaaaacgtttcaaaacattaaccatccgaatcaattaaattttcagacaataaagttatcttttccaaatatattatggatatatatacccatcgtcacatttcttttctctaatttccatatcaaaactaaaatgaatataacaagttgagtgaggatatttttaaattaataaggaatgattttcattggtcaatccgtggaaattacattgtcggtaggtcaattaaaggcgcaattatgatgcaatatataaaaatttagaaatattaagagccatgtgactagaaccatgtatacaatattttatttcccttcgtattaaatcaccaacgaccaaatctaaaggtagcaaatcaaacagccccacaaatatatcaaaatatataaagaagtaattaaattaacaaaaacgaagaaagtataggtttcactctcttactcattccttacatgtcgaccaataattctataagtatctaatgacatttcctatctttctttcaatccataatcttatcatataatcaaattcgggaaagtttttaagtttcataaactctataaattactctctaccatcttaacctaaaaaacattctcaatcctttgtccaaaatcttgcatatcggcaaa

SEQ ID NO: 281 - DNA, 3000 bp, Arabidopsis thaliana
tataaatctattacaattagtgacaaccaatcatgatatttggttaaaacaatccatgcatatttgttaatccacaaaaaaagtttaaatatctaactctgaaatctctaaaatctttacacctatgcatctaccaataatgattctgaaagtttcagaaaaatgtctggaaatatataactgtgttgggttttcatttgaaaattatgatctcttactagtaataacgtcatggaaattgcaacacagaaaaagacttataaagttttctgatatttttctaatttaggattttctttttaaaaaatacaaagaaaaaccgactatagaaatgttggtgtaaattaaacaggaggaagagttttatccaataatacagtatacaagtaacaagatgaagaacctcgggaacttgatacgtttgagggttaacagtgaatcatattttttatataaccaagtcataaactagagaaaccatataaattgaacaaacgaaaaaagacaatctcacttccatggttagtaatctttcatttagaaagatcttaagggaaatatataattgtatattctctctctataccacacaattccgatgaacacacaatctggtatattgtacatttgtttataatgcttggcacgacggcttgtgataaggctttatcgtctcataaaaggaaaacgtagtcattcgatcatctcccaaagtttcaatcttctctactgtcttcgtttatttcaaatgattatgagttgattaattattcaaaacacagaagatctctctatacatatatatatatatatatatagaaacctttcaaaccatttcgcaaattggttgtttctcactttctctagcgtaaatctcgatgagcttaagttaaaacttaccttcagggtcatttgttttgttatgtgacaatcttctagattaatattccacttactacttcctgcttaaaatatttagttacatcacatgaccatgtaattgaatttatcctctttataatataaactacgaaaatctgaagaagaaaaaaattatcgaaaagagaatcatattctggtactagcaaaataaatttggtagaagatatatatatatttttctatatgtaaacttcaaaattaatgcctaagatatgctaaaaatttgcgaaggagtcagggggaaagcttgagaggaccaatgcatggcattgcttttactgacagtaaacagtgtcacgctcacgacccattcttcccgttccatttggttttatttatttcaaagtttaatattccttttgtataacattcaaatcttcacatgattgattgtgtgaaaaccccacagattttactacaatagggggagttgacttaaaatagctattgatgtcgaaaaaatgtattttagttataaattatactaaagaaaatttttgatttgtctgttgtttaagcatatgtattgttaaacttaaaaaaatatgtattgttaatcttaaaaatgtaggagtacacatcaaatactcgagcataatcaaaaccgtattcatagaccgatgtgagaatcaaatagaagataatgtgattttttaaaatatcgtatctccaaatcaatcacttagaagataatgtaattctttatgtgctacataaataaatatatatatatatatatatatatatcttgtatatatgtcttgacaaaaaattgccagtcaaaaaccatgactgaatcaaactataagtcggattgaatcaaactataagtcggatgagtattaatttccattatgtttctatactttacaaaccggaaaatagatattatagataccaaaaaagtagatttgtgtatattattagaagatttggaatttcatcattatcaggatctaaagtacttccctaattaaatcatgtcggttgaaaaagctcaatgaatgtttgaaatttggaaagtttattaaattcggatcttttttttttgtttgtcgtcccaaacatttttattttattacaaataatcaacttatccttactactaaatcatttcatatctttgataccaacaaatcatttcatattctattttgatgtttaagaaaacactatttaccagttacaaaatattataaggattgttgtttagaaaaaaaagtacaagttgaattctttttgtcaaatataaaattgactttttaatatataattgacttattgaacatgattacagaattaatcatctacaaaactttccaagtttataataaatacatttcaaagactattagttcttcttaaaatatttctaaaagtgatcaaagactaccacatataattcagaaaaagtagaagttgatttctttttgtcaaataaataattgacttaaaatagtttggaaagccattgaacttgattatagaattgataatgtacataaaaaaattccaagtttataataaatacatttttcaaatgctatatcagttcttcttaaaatatttcactaaaaaaacactcaaatatagaataaatttattgaataacataccaactgtaaaacagaatttgacaaaaaaaaaaaaaaaatgaaatgaagatgaagacaaaaataaatcaccagaggatcttatgcaaaaaaatatatgaatacacaataaaccatattgatatttttaaaataaaataaaaacagaaaaatatcccaacaccgcttttcaattaaaaatcttccgtcaccattgttgtcatcttcctctctcgtgaatcctttttcctttcttcttcttcttctcttcagagaaaactttgcttctctttctataaggaaccagacacgaatcccattcccaccgatttcttagcttcttccttcaatccgctctttccctctccattagattctgtttcctctttcaatttcttctgcatgcttctcgattctctctgacgcctcttttctcccgacgctgtttcgtcaaacgcttttcgaa

SEQ ID NO: 282 - DNA, 3000 bp, Arabidopsis thaliana
ttgaactataacaaaatcccaaatcataaattttaacttaagggtttcaagatttaaccaaaaccataacactcagattcgcagatgagacttgccaagaaaagtataaagatcaaattttcagatcaagaacatagtaaaagacaattatagatacattcatgagtcaaaccaaaccaaacccaaacttacttaataggaagagagtcttcaagagaagaactaaacgaatcaagtgttcctcgttggcacgaaacggcgtcgtcttcttcttcttcctcctcgttttcactgctttctccgatagacgacgaactatccgaagattcctccggcgacttattattattattactcatccttaatccaatcccgatctgtgatccaccacgtcctgattcatcagccaagaacagagccgtttgaacagccttatcctgcgccgaaacaccgcgatgatctctaacgtacgccgccatgccgattccaaacgacgaaccaaccataacctccatataaacttttccgattaagatctctttctctagcctgtgaatatacccgaaagactcagatgatcataaatcgccggcgatgtgcgtaggtgaagagctttaaccagcgcaggttaatgatataggaagagagatatacaaaagaaggtgaaatgcaaaacaacactgaacgagaaaaatggaataaattctcatttacatttataacgacaatatcgtataaaaatacgattacgtattgaatacgaatatttatacgtatttatgagtctggaaacacatgttcctaaatatagaatagtcctaggcacgctaacggcgactttgacggtatagacacggtcttgctgacgtggagagttttcattggtttaagtttggacttttgccggacgtttcgggttactgtctccgtttaatccgatgtatgtcgttgtaccgaaagttcggtggtcactatcacaccatatctcaaccttatccatttatattttgattttgtttctttaaatgttttaagatgttttagaaatatgtggaaaaagggaaaaaaatcttgattagttatatcaattcaattggatggataatatttggtatgcaaaattaagatgctgatttttttctgttaataagtcaaaagattacaaaaatattcgtgtatgatttactttatgtttttaaatggaaattaatatatttaaaaatatataattagtactatctgaatgattagtttagtacaagtggacaaattaaaccttatctcgtttacttttagtacaattaaaaccaatatcgttaatgatacaaaaaaatctatattataatgaaaatttgctaatgctggattagtgcggaagcaagaactttgactcgttcaaaatgcgaatattggtttattttatactttaattagcaaattactttgctgagtcatgaatgtttaaaatgtaaaatgaatccaaaatcatctattttacaatatcatatacatgagatcaaattattgtatgatccaatcctaagattttaaatgttggtttttatacagttcaaagcaattaggttttgttataatcatgagttgatatagatcaaataacataatatatggagggatatcattagaccaattagataaatctaaccttatctctttaactgataatcttgtttatgaaatgtggctaacttaagtctattaattgtgtctaaagggtatcttcctgtttagctttacctctggcattttattttagaaaattcaatggtggactatgaaacattttttaagatattacttttttgtcatcctgttattaaattaattatcaaaatctgttaagctcttaatgttaatgtatttcctcttgtttataattacgttgttagactttagatcttgacgatgatactgaaaagaattggtagtttgacttgtataaatcgaatatgtgaactagctgtgttgttgtttgctagtgacttgatgaatgattgccgcatttttttttaattgaacatgttagttgtgtgtatacttgtgtcgtgtgtatatttgtccgcatttatataatcgagttgatagacacaaaattacttccaacactcgtataacctatatagccagtttaaacttttgagtcttaagtatataagtttcaacccatcaaataaatagatgggttatattctcccataagaaatctcgaacccaaatttatttgagttgggttgagtcaaccagttcaattaatctaatggataacattttgcatgtatttatggccccataatatagaaatagatctggaagcccaagcccaaccttctcccacttatactcagagccgacatttggtgtcggcaacgccaatatattattggagaagttgaaggaagactcatgttgtgtggcttcagagagtgatgccaaaaatacgagaactagacagacccgtgagtgatatcaattgttttactcttcgacacagacaaatgggaaacacgcttaccatcatatattcatataccttttactcaaatgaaatgtgaaacctgatctccaagactccatttttcagcaacttctggggccaagtttttgtatcagacgcatcccaatatgataagtttcacttcccaagtatttggtcttttctagcatatatattggatttatctaaagaaaactatacactaaaaatggttagcaaaaaataacactttgctttaagtattaacttaggtcctcttttaaaaccttgcttaggtaaccatattctctattcagtcgttaaaatctttattaatactataacccggcttttgtttttatttttcagcaaaaaaaaacacaaacacacacacacatttaatcagaaatccagcaaggtccaacaagaagaaaaaacacaatcaaaattccttataaattaatcaaaacactagctagacagtagacacaatacaaatcaaacta

SEQ ID NO: 283 - DNA, 3000 bp, Arabidopsis thaliana
caacgactggtctcaattctacaacaaccaaaccttcttcaccaccgcaacctccaccgtcacaaccaccaccaccaccgccacgtcagctgattctcctctgagtccggataatcgccgtgttgcaaagccaacacgtcggagatctagagcctcacgtcgtacacctactacacttttcaacaccgacacagccaacttcagagccatggtgcaacaattcaccggcggtccatccgccgttgcgttcgggtcttcgccgtcgtctggttttagtctcacctcgtctgatcccactgccggagtatcttcctctccttggcaatacgctaatttgcagaaccaaatggctcataacgagctaatgcaacaacagcgaccgtacatgttttcgtcgtcaaacaacgtgagcactcttagctatcctaacgcagtggctaccgatggttttgtgggggcggaggagagtagagagggtggtggaggaggaggaggaggttatgctccgtcgtcggagaggaatagcaatactacctattccgaggaaaaaacggtatattattcttagaaatgttctttttctagttttttacctattccgaggaaaaaaaacataaaggaagaaatgttaggtatactgactttgtttgtagcagaatgaaaactttgactattgtaattttctttagttgtttattgtttttcatattttgaggacttgtggacggataaattaaataaacttaatagaattatacgattcaattagagataaaatgcggtatggttttaataacgcactacataatgcgattttgtcttcattcagaactttaaatagcatttaccaatttgagatatcgtcatttcgagtttaagaactcatttagaaagggaaacaaaaaatttaagcggctttggaaacaaatatactcaaacgtgatcacatgatatggataaatatgttcataactattcgactacaaaattatgcattttggtgttcatagtttagtattcgaacaacttgttcaaactatcctacataaattcgattataagatcccgtagtcgtattttatatgtatgaatattcgttatggtaatagttcgagtatcatatacttgtacatggaaaggtctaaatgaattttcttttccttttccttccatgtgatgatcaactttagaaaaatcttagttggcttttcaatttaaagaagaattttctctacagaaagagaagtgaagaataaatattttacgtcgccgttgcttttcgttcagaaactaggggaaatgagtcggtgaaggtaggctaccaacatgtgaagaatctcacatgatgcgtttctcttttcttctcctttttcacaaaatgaaaaagtcgtttatatcgcataaaaaacgagtaacaaaaaaagggttagagacgggatgaattaatggcccatatttaacttaatactttttctgaagaaatgaattccgttaatgtgaaaattgtttgcttgcttactaattacttttgtgcttccataccttttttttgttgcatatggttttaaatggtggcaatctggagatcttccgagcttagttatatgtatgatgggtaccattcggatatgttaataatttggttttttgctttcctttagtcggttttgaaagaacccgaactgaattagaactttgaactgaaattcaaattggttcattctatcttggttttaattttcgaacatgttaacattttccttctcgtatgttagtttcagtttttgatcctttttctgacaaaccgactctctgctgtcggattccgacctagcaacacgaccatctcaaatctaacacttttccttcgagatccgacgatcctcatatactttgagcaaagaccacctaagtccggttccgtggaagctaaatcatagcagtctcagaggctgattgttcaatcaaacaaccataaactagaatccacgaccgccttctaagaaatctagggattgtccctgtatataaacagttagacagtacatataaccaaaaacgttgttgaagcataaacgaatatctcttaaagtatagtaataaaggcagtccaaactcaatatacatagtccgggttagaacgtcatatatgatatgacatcatggaatgacagataaggtgcaaaactatcggaggctctctatttgaagtgaaacattgtgctctttttatattctattcaaaagttatatataataccaacagctaaacaaccatgaacaatatcagtttagtgagttttatatagttaaaaacttagaaaactctaactgatgtaaaaccaacgacaagatcaacaatttttacctttatttcaaaaaatggtttaaagaaaatctataaaatgttaggctctaattcatgactcatattgtttatgtcattacttattaatctataaaagtttgagagtatggatgacacaatttgacccacaacatatacaacaaccacctgtaggtgtgtgtacatgtacccgggccaacatgttcccatgcgatcgaagagcactagtatcctattcggctcaaatattctttatacgtgacttctttcaaatcattcttatttttgattaatacgtttacgaaaaccattaatatatcaatatatggctgaccaaaataaaaaactatatattaaaaagaaataccaactaatatcagtgttcaaagatggccgacctatgctctcaccatctctcaattactatattttacaaaattgtcgtctatcacttttttggctttaaatgtgaatgtgagataacaatttattttaggttgcaaaaattgaaaagtcttatcggaaagaaaaaaaaaatccaatttagaaaaccgcgcgttggagggaaagccatagaaaactaaaagataacaaacattttaacaaacccaaacccaaaaattctcaaggaggccgaagaagaagaagaagaa

SEQ ID NO: 284 - DNA, 3000 bp, Arabidopsis thaliana
gactgtctaactgacaaattttacttgttcaactttaggtggtacgaaggagtacaagattctaatggaccaatttcaccatgtttctgcagcttttttggaacttgaaaaagggttagttctaatatttgctatacgcacttctgttctactttatagattttttctgctcatgttgtctcacgtttattgagttactcaatttgttgatactcttatctgctttctgacaatactaattacctcatttttaacatatgcttttgtatatgaaggtatcaagaggctatcgaggaaattactagaagaatgggtgcagggatggccaagtttatctgccaagaggtctgtgatacagagcagttttcgtagttggatttgtttttgagttatggtgacaaaatgtcttgagctggactgaggtctctgtttcagttagaattctgtcatgcttaatcttttcataagtcataaatattggaatgcctcatgtgatgcttctatgatatgacaagtagtaattgtattgaaagtaccaaaacttatttataagttttgtaaagaaatgaaatcatttgtttaccgatccagttgatccagttttcactattatacacaggtagaaactgttgatgactacgatgaatactgccactatgttgctgggcttgttggtttaggtttgtcgaaactcttcctcgctgcaggatcagaggttttgacaccagattgggaggcgatttccaattcaatgggtttatttctgcaggtacaacaatgtattttgaggtgtacaatgtttcttcttcctcaaatcttttgcaatttcggacaatttctatcattgaatgatttataacactggtcttatttgcagaaaacaaacattatcagagattatcttgaggacattaatgagataccaaaatcccgcatgttttggcctcgcgagatttggggcaaatatgctgacaagcttgaggtgcatacataccactctcaagctctcatcttaggtctgatgttacccatattgactattttctgacagtgcctttttggtgatttgtaaattgtaatgtaggatttaaaatacgaggagaacacaaacaaatccgtacagtgcttaaatgaaatggttaccaatgcgttgatgcatattgaagattgcctgaaatacatggtttccttgcgtgatccttccatatttcggttctgtgccatccctcaggttagagaacgaaatatcacataattgttaagtctttaaacttcacattgagaactgtttatattgttttcctcttcatatggaattaggtattctcctctttaactacgtctgcactaatatagaatgccttagaagttaatattgctttgcttgggtgtattttcttgattagatcatggcgattggaacacttgcattatgctataacaatgaacaagtattcagaggcgttgtgaaactgaggcgaggtaagatgttaagccttagaaattatgtaggccaatccctaatttctatttatgagaaaggaaaacccgttatcttttattatcaacgagcttgagaacgtgtagtagctagccttattatctgaaggctaatatcgctgaacaactatctattgtttaggtcttactgctaaagtcattgatcgtacaaagacaatggctgatgtctatggtgctttctatgatttttcctgcatgctgaagacaaaggtagtcatcagttccatgtttgtgattagtttttcactcagtttctgtttaaagaaaagaatcatatgtgaattttctatcgacatatatgacataggttgacaagaacgatccaaatgccagtaagacactaaaccgacttgaagccgttcagaaactctgcagagacgctggagttcttcaaaacaggtacagtcttttatttaatcccaaaagctgcattaaatcctctcactaagaaactggtcacaagcacctataactaatcttccaagtattctagaataggatgatattatcataatctttctttctggttgggtttctgctgaatcattgtgtctcttcctttcagaaaatcttatgttaatgacaaaggacaaccaaacagtgtctttgtaagttacatagtttcccttttccatataagtatctcatttttaaaaaaatacataaaacttatattctatatattctacccgaaaatgcagattataatggttgtgattctactggccatagtctttgcatatctcagagcaaactgagtgatccatgtaagcgagtctgattgtatcaccatcattcaagatgttcagagcaaatttgagtgatgaagtaatctaggttgattcttattcacgccactgaatcctaagcaagattgtttccagaacaaacagagtttaagcatggtttagtctaaaaccatggattctattttagttactaccttcgttatctaaacgtgcatttgttcatctatttttattccttgtgtttaaagttctttctttgtttagttgcgtttcttctttcgttctcttttggcatgttttaagattaattttaccaacaacaaccagataaaatccaaatgcaataagaaagaaagaaaaatgacaatcgaagactgaaatctcttctttctttttaggtcggcaaaaaagtctcttcaaagtatataaaacaaaaacatgaatcaagattagatttatctttttaacgttaagtgtgtagcacgcggcaagcaatttaaatgcaaaaatagaacatagttggaccagtaacatgtatcaccgtggcaagcttaagagcaaggctaatagcgattctgtggaagtgcaaggtatgcaaaggccgtggggtctattgatttattaatagggccatatttgttgaattatagcacatggcctaccattttgttccccaacaaatcctccattgtttcaaacgagttctgttttttctcctctgtttctaaaa

SEQ ID NO: 285 - DNA, 3000 bp, Arabidopsis thaliana
gactatctttcttttattttcactgttatccagtactatataaaaacacaacgctgcaaatatggttcaaagtgcaaatttaatcatccaagagaagaggctgcagtaagtgaattttccttttccaaataaaattatccctcgggttgtgtatttgcctgcagacactcgcataaaatcttgtgcttgtaatatgtactgctttagttttttcttgggctgtgcatgcacctagaagcttgatgctcttctttatttcaggttagtgttgaaactcaagattcattgcctgagaggccttctgaacctatgtgcacagtaagatataaacataattgattgacctatcctatttttataaatgctcttacatatgaaactaatatcgattattaatttggcatttctactctgcatcagttctacatgaagactggaaaatgtaaatttggtttgtcatgcaaattccaccatccaaaggatatccagctaccatcatcgagtcaagatattggtagcagtgtggggttaaccagtgagcctgatgccacaaacaatccgcatgtcacatttaccccagcattgtatcacaactcaaaaggactacctgttagatcggtaatgaattcatcttcactttgcataagactgacttataatcatataggcacaatttgtgactttctactatcttattggcactatacttagaactgattatggtttgctagcattgtatgctgacctgttctgacgtctgagaatgaagtttcactaattagattgtagctttttcagggtgaagtggactgcccattctatctcaaaacgggaaggtgaatatctcttgtataatactattttgttgtttagaacattgaaacaaagaacgtgacattaacgttctaacttgttttccttttccataatcagctgcaagtatggagccacttgtcgctacaatcatcctgagaggactggtttgtgatcatgccaaaattttgtggtttttagaacctttaacgtattacttttatccctaaattctcataatgtgcgatgttttgattctgtgcacagcattcattccccaagctgctggggtaaactattctctagtttcatcgaacactgcgaatttgaaccttgggctggttacaccagctacctctttctatcagactcttactcaacccacggtaaaagcctttattcatgttgtgagaaatattcaagagcgcttctttagttgataggggtttaattagagtggaaattgtttcagcttggagtgatttcagcaacttatccccaaagacctggacaatcagaatgtgacgttagtatccttgtttcttttagagattgctgagctttttctcccacatgttagttgaaattttataccaaaagctctgtctttcaatattacagtactacatgaagacaggggagtgcaagtttggagagagatgcaaattccatcacccagcagataggttaagtgcaatgaccaaacaagctcctcaacaaccaaatgtaaagctgagtcttgcagggtatcccagaagagaggtacctataaagtggtattattagaagcctgcatgttgtgagtttgtgtggtaatctcatagacaaaacaaaaactgttgcagggtgcgcttaattgcccttattacatgaagacaggaacttgcaaatacggggcaacatgcaagtttgaccatcctcctccaggtgaggtgatggctaagaccacttcagaagccgatgctgctggagcaaccaacaccgacactactcaatgagtttcccagctttgtgtaacataagatgatatcttgttgtaatcctagtttacttcctatgtactgcatctgtttcgtttcgaaatgcttatcgctcgtgagttctctacttctctttatcatcctaaaacaaaaaagatatcgttgagtgagtcttcttttactcagttgagctcataaaagcaaaattgttcatcaccactcttctctcctcaatgatccaattgagcatttatctgccgttgattcggttctcttggataaatatcgtttccattgtgattttgtttatagcaattgtcagtaaactccaactaatctccacaataagatgaaacaacacgtaacaacaagatgtgacagagtgacgacagagagccagtgcatgaaacatgcttcttcagcaagacacatgtcggtgctaactgctaaatcaaaagtgggtccaatgttttgttcttaagagtcgaagaagaggacatgacatgagaaacagaggcaaaggaagaaaacatggactagttgtctccgtgtctctgattttaagttttgatgaaacatgtggaaggcctctattaatggtataacgacaaatgatgaaagtagcaaaggaggactcaaaaagtttgatgcctttttgattggatcttttaaaaatatgagcacacttccctataatacttctataatccaaaatactcttttgggcctatcttaccaaaattatgcaaacttccacaacacaaacacgagtgtcacaaaccctaaatctaatctcaagagtctggagcagaaaaataaatttaccatggttttgaaatttaccgtttcagtccctttttattttattttcttactcaagcccaatgttgatgtattattttgagattaaaaaacttttgaccaaataaaaaaactattttgatttgctttcaatttgggtttaaataagagtgagggtctcgcaggttagcttataagccgccgccttgaaaatccagaaggccatttttgttggtgaaaggtagaattcgtaaatttcttctgctcactttattgtttcgactcatacccgataatctcttctatgtttggtagagatatcttctcaaagtcttatctttccttaccgtgttctgtgttttttgatgatttaggtgaagaagaagaagcagagacaaaaacgatt

SEQ ID NO: 286 - DNA, 3000 bp, Arabidopsis thaliana
gttaatttctacgatatactcggaaatccggatactcttctctagctagtgaaacaaaatagttattatctataaggaaatagctcttaaatcatgaaaattttctaaaaacctccaacactgagcttatgcaaagaacctttttagtgatcacatattaaaaaagtggaaagagaccagtatgtgttcatcatcaattcatccttagagaacattaggttatatagtaaaagtgaaaacccaaaggaaacagtaagtaagaagttgatcacgttcgtggtcaatttaaaatgaaggaagagggtcatttctcacaatcattagtcatttctcacaacgctaagcttatccgagatgatctttgtagataatactttattttgttgtcgttgttgtaaatttatactcctactaaagtcatatgtttgtttttcttagaaggtggagaaaatgcaagtgggcgatactcccaactgttaaatcagcgtaagatttaggtgatatgatttgatggaggtacgtaccacgtacaccgtacaaatggaaattagataatgttggtcaaggtagggagagataattttaaaatttagaggagacaaatagtccacgattatttattttctaattttccacaagtaaaagtactttctaatgtgattaaaaatgttcggtctaaaacatttacatttattatgaaggtatttttgaccaaacatataacttttttctctttcaaatacaccagtatagctaataatatcacataattttgcatagatatctacaaacattaatttgcttgtatgatattgacttagtagctattcttcatatagtaaacgtaaatatatttttttggtgagaatcatatatataatatctttgttttctatgtaacttgttttttttttttttttggtaaaaaatgtaacttggtttttctttactttctttggtttctcatatcaaatcagagatgtttactgtttttgttaagtaatgttactctaattagtgaaaatagtgttgaaacggtaactctgaaatcagaaaggtattttgcagatcatctttggttgtataaactgcaaattaggtttgaaatcatcttcttgaccaaatatttcggtaacaagaagtcaagaactataatgagaaaatcaaaaagcatctttctttaagcaataaacaaataaattgacaacaataattccaaattaatttattattcctcagttaaaattcagaaatctgaatatacaaattgaaaatagccaagagaaatataaataagaatctctcgaccagaatcaaaaatatctaaattaaaaactgagggctcctctctccaaaaaaactatctccttcatcaaatcttcatcattctgggacgacgacactggcgacaaccaaaaacaatatcaaaccctaattttgccatctccttcccaaaaacaaagtcaaaaatcattaaaaaaaatagcaacgaaattaaattaaaactttcaaaattaaatctctaaccaaagtttcaatcacattccgtttgcaaatttcattagcacacagatttttcagcaatcccaggaagtaacggacgagattcaacgttgttcttcgccaatccaacatgactacacctccggagatcctcaagcgtcgccgccggaggattacctcgtccagatgatgatgacgactcacaccgagtcacaatcgcaataatatcctcaaacaacgattcatcacaaggaatcgctaacggaccaacgttagcgaatccatactcttcctcagcctcagctagaagccgtcggaaaatcggatggttcaaatgcttagcacggacaacgtatctccgacgattctcaccgacggaaacagcaacgtgaccaggaggtacatcggaaacaggatcgttgttgctagatccgatgtgagcttttttctgccattgtttaagcatctgacggatccgaacaacgcttccgatcttattgttcttccccattgatatcgaacaattgcttcttgtggattgcttttgcgttttttggctcgcttttccccagaaaatgaagggaaagttggagagcaaaaaaaaaaaaaaaaaaaaaaggttagagaagagacatttttgctttaggcgttgctttcaccaaattttggaataatacggcaagcaggggaatattgaagggagcgttacggtatttaaaggttaatcatttaggtttcattttgcccctctaacgtttgctaaattacgattttactcttctctatttatggttttttgattttttttctctttttttttccttctttatcttataaataaaagattcatagctctgtttttgttttcattctttttaacaaatttttttcagaaacaaaattggtcaacttttcataattggtttgtgtgtattttttttggtaagaatattgaattgatgcatatatcaatttttttgtttttaatatataatatcttactcaacacataaaagaaaattaataaatactcagatatcttcttctttatttgattttccttaagaatttgaaagagcaggctttttacaaagcctcaaagaaaagcccatatggctttggtttgatgaattaagaattgcttttctctaattgtgtgcgcccgacccgctttgtatcaagccgacccgtttcgttttaaaaatgcattttgagccacagaaaaggggacccaccacgaaaaaaatagagattctcttctaaaatatcatcaaagtacaaagaatttaaagccgaaagaaaaattgtttaaaaagattcgcagaaaaaaaaaaaaaaagggtgaggcggtcacttcactgacgacgtgtgctatacatacacagtcaaatacaaccctttccccaaattgaccccaaaaccaaaaacaaatcagaagaaaattaaaataaacctaaaagagcaaatttttattcgcattgctctcaaaaatcatcc

SEQ ID NO: 287 - DNA, 3000 bp, Arabidopsis thaliana
taatcacctaatttccataaatgtagagattactgtaatcctgtctacgttggaaataattaatggtaccatgtcacccgtaatagcaatggcttaatcatgtttaaagagacaacaagtacacgattcgcgctttacagttgtataattgtaactttaaaaacaattatggatgcctaatcattagattattttcttcttctgaatatctctccacaaattaaatgaagccacgaccgacataaacaaagtggaaacaattacagtaattcaaacacatgcaaacaaaaaaactcgagttaattattactaacatgttttagtacttctgagaaaaaaagaaaaaaacaggatccgctgtgtcttttttataatgatgaagttcctcgctttcaacgccaaccaaaaacctccagaaagctaattagggaaacatttgaaaaaactcagtgatctgctcttctctctaattgcaatggattcattgagattaatatctaagagcatcaagattgaaggaaccccatttggttcctctcaccaacgcaatcaaattttcctcaaatccgtcgctttcttccttttgatcggtctcgcttaccgttttctcatcactaattccaccgtctctccggttcccaccgttcgatcctcgccggaatctctcccgccggatccttcaggtctcactgccatcactcaaacttcagcctctgtcgattccccagcaaacatcacaaccattgcttcacagaatggtaagagatcatctttttccgatcatcactactttagtctcaaattcaatagagtaagacccaagcaacgtgaggaaattgggttttgagaagaaattcttattttggatttgtgctcaccaagtgtttgaacaattgtagtttcaaccaagtgtgatatctttatcgggaattgggtaccagacccatcagggccaatctacaccaatgtctcttgccgtcatatccaagattaccaaaattgcttgaaaaacggaaggccagatgtgaattaccttcgatggagatggcaacctcgcgattgcgatctcccgaggtttaaccctgagcaattccttgacaatatgaggaacaaatggttggcttttatcggtgattccatctctcgtaaccatgtccaatccctcctctgcattctctctcaggtacaacaacagtttctctaatttcatttctctgtatagcagcagccttaaatctacttgcccttgttttaggtagaagaagtagaagatatcttccatgacaaggaatacaaatcaaggatctggagattcccttcttacaacttcacactctctgtcatttggtctcctttccttgtaaaagctgaaacctttgagaacggagttcctttctcagacattcgagtacacctcgacaagctagaccagaaatggactgatcagtacatcaatttcgactacgttgtcatctccggtggaaaatggttcctcaaaacaacaatcttccatgaaaacaacaccgtaaccggatgccattactgccaagggaagaacaatatgaccgaactcggttatctatactcgtaccgaaaggttcttcatttggttttagactttgtcgctgaaccgaaccataaagctcaggttctcttcagaacaacaacacctgatcatttcgagaatggagagtgggactctggtggtttctgtaaccgaacaatgccgtttacggaaggcagcgaaggagagatgaagagcgaggatgtatcgatgcgtgatatcgagcttgaagagttctataagactactactacacaacaagaaggttccaattcaaacattgtattacttgacacaacttcaatgtcgcttctccgaccagatggacatccgggaccgtaccggtatccaaatcctttcgctgggctgaagaacaaggagctgaatcaggttcagaacgattgtcttcattggtgcttacccggtccgattgattcatggaatgatctaatggtcgaggtgatgcttaaccgggaacggcaaagacgagaatagcctctcgacttcacgtgctgttgttttctaattagtttgtttgtttgctcgtaaaaaagcccatttattattggaccttccgtgggtccaaatacaagcactgtcgttttttgatgtgggaatgaaacgccgtgtcgttttacttcctcagccaacgttaacattcaggaaaaatgggccacggaaccaaatgtttaaacattaataacgatgcaaaagtttccaaaacttgtaaatcggccatcattcagatctgcataacaatggcctataaaattattgagccgcctctcatgacgtaggccatttagttgttactatcacattcaacacgtattggtatttcaatttggtggtacctaccatttcacagtgagcgttacttcctcctctccatcttcggtaattgaatgacacttatagttatagcttattattcgtctatttcttctggcaaaagtcaactatcagtatacatcatattaattcagcttcatcaacaatgacatttttatctatcacttataaaaggaaaaaataaacaaatatagatatgatttgccctttttcttttcttgtcgtcattcgatcatcttaattcaacctcacgatctgcgatatactaaaaacaatatattgcttgtctattttcttatttcatttatctagctccaatcaaagtattgccgacaaacccatacactccacagtccacacaaaaccaaacggatcaatgaatgaaacaaaacaaaataaataatcccaaagaatactattttaatcactaaagcaatgttaaaaaagttctttgtaaaattaacttaaaaaaaaaaaaaaagccaaagggactatataacaactattagtcagtcaagataaaaaaaaagaaaaaaaaacaagttaaagatagaagattttttttctatcaactcatgcaaaaa

SEQ ID NO: 288 - DNA, 3000 bp, Arabidopsis thaliana
ctctctgtacttgtagaaccttgccaagaaacctcagcctacacacacaaccatcaaacagctcaatcattggcttttgtcaagaaacaaaaaagagtctgagcatattaatggaagatgagtaaatccgaaactggtacccatttaattgacgatgtgcttgagaagcaaaagcttcattcttgaaatccacaaaagcagcgtttctcaatctgtgacaagtaggattatatgtcaagttagagcagttccacattctctagagtaaacaaaaagtctttccaccttgtaacctaaatattccattcaaaagcctgatgaacaaaaactgtctataaccttttcagtcttctacagaaatctagaaccttcttactaatatgaatctccaagtaaatagaaaggaaaaggttgctggaaatttactttccaccggagcaaggacgaacagcagaagctccgtactgagaaaagagccgagagacgatatcatgaggaattccatcaggaagatgccgaactagaagagttaccccgaacggctctgtaacctgagattcaaattgcgtcgccgggagattcacggccggctccgatgtcgcatgtgcagccattattagagctcgaaaacccaaactcagaacgatgacatgttcttttcaataaaattgatttgggagattaaaccggactagactttggggtaagttaccgaaccagaaaaaccaagagagaagattgaatcaaaccggggagacgttttgttttaaagtgtatgggcttttccacacatgtggcccattaaaatgttttttttttggttaacagacctatctctttagctttggcaaatggcaacaatcatttaaatcttcagtaatatattttgttactttaattgataaataaatttaacattacaaaaaaaaaaaaatcaatagatagatgttaatgtaacatgaggaaataaattaattttgaaaaagaagaagaataaactgggagatggacaatgcaatccaataagaagatagagttgatagtgaagtgaacatgactataacaggttacttgactaaatatactttctttcatccgtttcaaaacattaacattgacaaatttttgtaagttttcgtacaattatcaaactgaaacttcaatttttggaaatattaagaatatgtccatttctctgagaatataatatcttttttggcgtgtgccttccacacacttcttatggctctccttgttttcttgtctcactcatgaaattccgcaagttcttcacgcaatcttatttatacaggaagaaaaagaagagaaaaaaaaatcttagcatctctacgaaaataatatatacattatggaatccattgactgacaaccacaaaaaataaacataaaactttaaaaattaatgttgaaattgagaaggagaaaaacaaacgaatattaatagtgttgtatgaattttgttggcatatataattaatcaagttggccgtggagttaatagaagaggcaaaaatgcatagatcaaacatgttttcttttttctttgtttcgaatatgttttttcgcataagaaataaatatgatgcgtcatttacataaaagaatatcgatcctttcaagttgttgtgtgtgtgtgtatctttaagtacctcttattatttgtgtcttcttccaatcttttatattcgtctcacatggattccaatttcatatacgtgttttttttgtcaacgtatatatcccatatatgctactctcctagaattcctaaaagctatattgagataaaaaaaaaaaaattattattctttctagatatgaaaatatatatgattgcgtgaagaatttgagagattcatgaagcatatcaaaagaaaacaaggagagccgtaagaaatttgtggaaggcacacgccatgaagagattatcttcttctgaaattcgcatattcttttcaaaaaatattgaaaactcagtttgatatttgtgaggaagtcttacaatttaattccaaagttgatgtttggaaacagacaaaggacgtatgtttttcggtcaagcaacttgttatataggttagtagttactccatatatatatttttaattactgtggttagttacactttttgtgttgtcgcaagtcatgcacatttctttctaaaagactaaaagctcttggctatatattttgaactgccccataatatagtaatggactctttatttctgtgtaattatgtgtttacatcatatgctacgtacagaaaaatgataaggcatcaaacttttgtgtagttgtctcatacgagttggaagaagtactacatggacacattcaaaccttatctcattttttatatacagaagaatggaataaaacaaacaaattatctcatttagctttcatgtaatccatcaattaatggagattatacgtttcatatcatccatcaattactgtacatcttgcttagtgtaatacaatatatccaataatttataacatttttggatctaatccatgttcacacaagtcatttttcataaccaggataattttgaaaatgattgtaaattttatagcaattaggaatgaaatttctataatcgaaaacatacactctaaacctaaactaaaaccttaaacctaaatcagaaatcatagaaactaaaccaatactgtaaacattaaactaatatcttgacttaaataaatcttttacttcaaaacctaaatataaggatctattcttaattagttaaacaaaaaaagaaacaaaaacgcaagtgtacgttatatagtatatttgaataatgaaatgttaaaataattagattctttttctagttgatgtagatccccaaccccacgccaataaatatccatccctccagtccaaacagttcacaccacccgagaacacacgattattctccaaagagaaagagaaaaatcaataacctcatagtgtcgac

SEQ ID NO: 289 - DNA, 3000 bp, Arabidopsis thaliana
agatagagaagctagaagggtacctgactaaaccaatgagaagagtattgcaagtgagcagatttggcttaagctttaatcgaatcatcttctggaagatctgtaacgcaacgtgaggctttccctcatgaagataagcactaagagcaatgtcgaatagagctttagaaggtggaggtgatagatgaagattcgggtgaaggagagagttgcaaagagagagagatgcatcggaggtgcggatataggagacgagaagagacttggcgtcggcgaatttgtggtgagagagaagagaacggacgacggagataagtggaagaggtgaatccgatggaaatgcttcggggattgaagtttgagcccattggaagaaagatactagggtttctggtttcttagcgagtgaaggagaagagaggagagaggtaaggagaggctgtgtgatttgaggaatgtagggatttagggtttcgaggaaatgggttttctctgatgtgaggattgatgttagggtttttagtaattgagattcgggtggctttaaagtcgccatttttgttggcaatcaatggaaatttatctgatgatcatcctcgttgtatcgtcaagaagaagaagaagaaagctatgaagctttttcactgtgatggtttaaaactgtgaagcgtatatttaaccgggattacaccgaaccggaaattggagaactcgggttttcggcttaaaccaaacgcaataggaccctgtcgtttcatgatttttttttttttcattggtaaaaatcatttcattctcaaatgttttggtcatgctacatagtacatacgaattttcgcatgattatttttcttataatttatattttaaaaaaattggatcagtaaagtaaaacagatttctttttaaattaaaataaatttatttgttttaattattattgtttattcttaggtttactgtatgacattcatatttctccaaaaccttattttgcgtagctacagacaaatagaaaaaaataatttacttatttacaagttagaaaatatcttttgcgaaattgaaatgttgataaatgtagtgattatattccaataaaaaaactaactgttgcatttgtgttttcatccctaattacaatataacgtttaagaaatgttaagctataagttagtaaaattatattttatcactaattcacaaacacgaactctagtacaatagcactaaattcgatgatgatacgatagcagcacgaatacaaaagcacttaattcaaagttgtattaaccactagattataagtttggtcagtgataaactaatatttacattagatataagcatttgctattcaattattcagcaacatctaaatctaagtattgaaggagcattatatattctatgtcgacgacaacgaaacgagccaacatgacatgaagctaggatactttatatgttatataagttataaaatgagcttctagaaaaagaagtaagtgtatatacgtatctacagaaatatcttgtagataggtgttgatgtagtgcaaaaaagtaagtctaaagactaaaagtgaaaaggacaagaaacaaaattttcaaaatataaaactaagaaagaaaaacgaacggcgagacattgcctagaacgcgacattgtcactgcaagaggctgtggctagtacttggctctaatgcaaaagtggggcgaaacgatagaccgtcgtagtgacttttgtccatgtcaattgcatcatcatagtgtcctttctataaagtcataataataaaagaaaaaaaaaaaaaagatttatgatactacttagagtttgaagatcatagttctttacaactatactttaagtgaacaaatagcgtatatatacgtatatttattcagtgaaaatatgaatatagtgtatccaaattatcatcttttaatatatttttcctcttcgtcaatttttgtatttgtttatttgatatatagtctttctagagtattggtttctagaagaaacttctgggacattgcttgcttccgtgagaaagttatacgtaacacctgtcttgcccaaatctttgtgattctttttcttcttttcatctaggttttacgtttaaacttacgcatgcatgagtgatattgatacataaggctataagcattaatcattattaatatatgggaaattactcgaagtgtcagctttggattatcactttcttcttcttcttctttttgatttgaaatttgatttgaaggtgatttcactgatatgtaacaaatgagtattttaaaatgttaatctttagataaaaattttttttgtcacaaatataatttaatttaagtcacaaaatatcccacataccttatgatgtctattattaccctatatgtatacgtaatattaaacttttatttaccctagtgtaatggtttttgctatcatcatcgatgtgtctccactctctacctaaattcaactcgataactaagttcgtacgtaaactagaatcagttgaacttacatatacagataaagtattatcagatgacactgttctttcttaatattaatgttatgacaactccactcaaccaatatacttgtaacttaatatgaattttatgtatatttttttttttctgtttaacattaaagatgacactattcgtttccgaatttatcctgtcttgtagctgattaatgtttgacacatacttgtataattagaaataatggttccctcagtttggttttcaaactcgagttttagcttaacttgtgtcgatgaaaataaactgtacacgtatgtattaaaatatttatttaaagcaccaactaaaatgttatgctatttgataatatccaaataattaaatcaatatcacgattcacttcctatatatatagggcttgcggaccgaacaacatatcgtgagaactaagaaacacccaagaaaacaaacaaactttttaaaaa

SEQ ID NO: 290 - DNA, 3000 bp, Arabidopsis thaliana
aagtttatacctaactttgacggtttaagataataactaacctattgaagaatataaagtggtggcattactgtaagatttgaatatgattcgttaccttctaattttttgtgtgaaaggctttctaatattattgctcatatcatttttgagtccaataaaccaaatgtatgtgatttatttatttgcattaattacgagataaaaggaaaactctgaaaatatggatacatgcacaaccgaaaggttagatttgactgtaaatcagaatttttattatttatttaagttacctatacgaaattatagttatccagtattttttgtgaaataatataacggggttccctatttcccttcaaactctttctactctctttttagatttgaattccatttacaattttccacccaagtttgcaaatgatgtaaacatgatggtgttttgagttgaatacattttagcattcattttttttaaaaaaacagtaaataagattttcatttgttgagaaaaaaatgaaaaaaaaaagatgaaaaagaacgataagaaaaaaggcgaagataaaaagagaaaaaaaattaaagcaatcgtgatggagggaagaatagtgaaaaagagaagaatgccacgtgttatatttgagaactctgttatgaggcaaagacgcgggctatctccaaaacgtgtcctcttcactaacgacttaccaaaccaatttgatttcacttctctaacccaaacaagaaaagaaaagaaaaaagttagacgacacaatggtccaatcggagaatagtgagacaatatcgaccctaatgtccttttacttatctttttacgtgttagtttcttattattttatcaattttctaatattttatccatttaattttataaatgtacaaaaacacctataatgtgcaagattttgtttacattacacgaggccatatcatatgctcatacaaagttggtttggtgtagggattcttccaatccgatttttatatgtttcttttgtattaaattattagacggagtttctagaaaataatacgtgatgtgtatttcttcactatataatacgcgaagtttgttacgttaattaaatatgtgtacaatagtcgcaagactcttctcattctagtaatttcattatatataatatagtaagaaaagaaactccggattcgtactcgagctcatagactatatatgatgatcaatagaaaaattaacctattgtgcttatacttttacaattatcatattccacgtaaatcataaattcaaagctttgcatggtgacataaacaacatattttgaaaacaaatacatatccaaaagtgacgatgatttaaaaattatgtcggtaattgagtatttgttgccaacaagtatttgagtaagttaatataaacgtaaatgtaagaataatccgataacaaaagtataaaacataaatgtaagaatccctgttgagagtgttgtccaaatagaaaaaggagtggtcgaacatctctatagatctcgtcaactaaaatccaagtgaaaaaacattatcaccagacaattcaaagttaatatcttagagtagagagcgcacgttaatgatgtaacacaccgacttttgtagataaattgcgtgcgtagggtattagtgttcaattaaggattttgttcacttcttcaagttatgaatatttttgggaaactggtttctaggataatagacaactgaaagaggtactactatttagtgttcaatgttttgtttaattcaggtatatattgacacaggcacaagtatttcgtatggttaattgcgttagctatttcagacttattaaattacataatgattagatgagatcgcgaagtattagagttcttgcgtccgaataattgatagattctataccctaaaaaaaaggtcggagatcaccctctaaattataagtataacataaatctaattgtacggacataaactcatgactcaagcaataggacaagccaaaaaaaattccaattattgtgttactctattcttctaaatttgaacactaatagactatgacatatgagtatataatgtgaagtcttaagatattttcatgtgggagatgaataggccaagttggagtctgcaaacaagaagctcttgagccacgacataagccaagttgatgaccgtaattaatgaaactaaatgtgtgtggttatatattagggacccatggccatatacacaatttttgtttctgtcgatagcatgcgtttatatatatttctaaaaaaactaacatatttactggatttgagttcgaatattgacactaatataaactacgtaccaaactacatatgtttatctatatttgattgatcgaagaattctgaactgttttagaaaatttcaatacacttaacttcatcttacaacggtaaaagaaatcaccactagacaaacaatgcctcataatgtctcgaaccctcaaactcaagagtatacattttactagattagagaatttgatatcctcaagttgccaaagaattggaagcttttgttaccaaacttagaaacagaagaagccacaaaaaaagacaaagggagttaaagattgaagtgatgcatttgtctaagtgtgaaaggtctcaagtctcaactttgaaccataataacattactcacactccctttttttttctttttttttcccaaagtaccctttttaattccctctataacccactcactccattccctctttctgtcactgattcaacacgtggccacactgatgggatccacctttcctcttacccacctcccggtttatataaacccttcacaacacttcatcgctctcaaaccaactctctcttctctcttctctcctctcttctacaagaagaaaaaaaacagagcctttacacatctcaaaatcgaacttactttaaccaccaaatactgattgaacacacttgaaaa

SEQ ID NO: 291 - DNA, 3000 bp, Arabidopsis thaliana
tttatgttcctagaacttttagcaaattatctacctctatctttctctcttctttaagagaaaaaaaaatggagatatcagtttcttcggtaacattttcactagctgtagttgttgtgtcttggtgggtatggagaacgttaaagtgggtttggttcacaccaaagatgcttgagcgttccctgagaagacaaggtctttccggaacttcttacacgcctctaatcggcgattttaaaaagatgatcagcatgttcattgaggcaacatccaaacccatcaaaccaacagatgatatcacccctcgtgtcatgcctcatcccttgcaaatgctcaagactcatggtatccttccatagttcgcttcttgattcttctctgtttagaacttataacaaaactgttgcaaagtatctgatctatatataaacttttgtatctttattatgctcttggaacaggaaggactaacttaacatggtttggaccaataccaacaatcaccataatggatcctgagcaaatcaaggaagtgttcaacaaagtctatgacttccagaaggcgcatacgtttcctttaagcaaaatactaggcacgggactcgttagttatgatggcgataaatgggcgcaacaccgaagaatcatcaatccggctttccaccttgagaagatcaaggtttaaggctttatttctcagtcacatatcaagttgtattttttcatttggctcttctgacccaacttttgcgtggatctgcttctatctattatatatagaatatggtacatgtgttccacgaaagctgcagcgagcttgttggtgagtgggacaagttagtctcggataaagggtcctcatgtgaggtggacgtgtggcctgggcttacgagtatgactgcagatgtgatctcccgtactgcttttggtagcagctacagagaaggacacaggatatttgaactccaggcagaactagcacagctagtcatgcaagcttttcagaaattttttattcccggatatatgtaatgaaaaaactctacttgtctagctttaatatagtgcttttaaatctggattcttgatctttaacttttagtgctgcaatctattagagatatgacctgtgttgtcataatcatgtgcttattgtttgtgtagttatctcccaacaaagggtaatagaaggatgaaaacagcagccagagaaatccaagatatactgagagggatcattaacaaaagggaaagggcaagagaatctggagaagcaccaagcgaggatttgctaggtatacttcttgaatcaaacttggggcaaacggaagggaatggaatgagtaccgaggatatgatggaagaatgcaagttgttctatttggccgggcaagagacaacatcagtacttctggtttggacaatggttctgttgagccaacaccaagattggcaggctcgtgcacgagaggaagtgaagcaagtttttggcgataaacaacctgatacagaaggccttaaccaactcaaagttgtaagtataaaccaaattttttataaaacaaactttttcaaatgacttcactacttttgttgcattttgatgatttaagctgatccctcacagatgacgatgatattatatgaggtccttaggctttatcctcctgtagtccagctgacccgagccattcacaaagagatgaagctcggagatctgactttaccaggcggtgttcagatcagtctacctgttctgcttgtccatcgcgacacggagctgtggggaaacgatgcaggggagttcaagcctgagagattcaaagacggcctctcaaaagcaacaaagaaccaagtctccttctttccctttgcgtggggaccaaggatctgcattggccagaattttacattgcttgaggcaaagatggcaatgagtttgattctacagagattctccttcgagctttctccttcctatgttcacgcgccttacacaatcatcaccctttacccacagttcggagctcatcttatgctgcacaagctctaatcacataaccccttgttttgttatcaaataaactcattatctttttatgtatccaagtcagaactcgtgtcatagtttaataaaacccttcaagatgtgtcaaaccctggattgcaatataatcatcgactgttgcttgacacttcttttcaaacatcactaacaagagacaaactatgtctttattaactctgattcttcctccctaataattatgtgttgcaccaaaagatattagaccgaactcgtgtctctcaaactattatgaaaacttcccacattaacattaccaaaacacttggaattcatatctttatttgaaaagcaagacccgagatacagaaatgatcgaaatgaataatacagtctcacaacagaagaaactaaataaaacacttccagagatacagaacaaaaacaaagggaacagagagatatgtaacttttttttttattgaagtaaaatattataacaacccgttgaagaaatacagaacaaaaacaaagggaacagagagatttaaagtttactttttattttatgtcgacaaaacaaaatacttcaagttcaatgtttaggtaccaaaaaacccattgattggatggtggtggtaaatgacaaagacacgtcacaaagttgaagacgttcgtcccttgcccgccagtcaagttatgacttatgagagtcacataaccaatattaatatatctcctattttgtctacttttttttacagaagtccaaatttggttcttgcgccttcgtggcacgcaaaatatcgattacttcaaaagaattatatcaacacaaacactataaagtatataagacatcatcggtgatgtcatcaccacatccatatcttttccaaagttttcaaccttttattccccgaaattttttagcaaattctctacctctatctctctcttctctgggaggaaaa

SEQ ID NO: 292 - DNA, 3000 bp, Arabidopsis thaliana
tttgtttttttatatattaacaaaagaatttattataaagaattaaaaattccttaggcatctattatttttcaaaaaaaaaaaattataaaaagaaatagttggcaagttcggaacatctagttggtaagtttgttgtcaccaagtgtgtaaggggtttgcgttccaaaacataggttcaattttttcttttcgaggggtttttattgcaccggaaagatgtatgagctccgtccacaactcatcaattaaccccaaaaaaattgttgttggattgatttttaaggtttgtatgttgagaaaaataaacaagttattcagccgtatttataattttttttgaaaaaatattgaagaaaatattaaacttaagtgatgatgtaggaagaaaacatcagttgattgatggtttaataatctgcctcgtgatacatggtgttatcttaaaatggtctctcaattagtctttgtatttgtataaaataaggcctaaaaatatcatcaatggggtcctgttaaaaacaaaaacagatacacctttcactaataaaaaaaaactgttaccgacaagtcaaacaatatctgcggacaaaaaaatgaagaatgtttagtaagaaatagaagatgtggtaaagagccatacacacatgcaagtgtttttcaatgaacccatcttaccaacccactacttctttgagccataattgtttggttcggagaccctttacatttccgtctcagctttatttgtttacgcattgatttgtcttaaattatgttagatattgttttttggctatttattagcagcaatcaagttaaaagagtggttcgatatcaccatcgaactctcctttagatattttctatataaaaccaaacaaaaacaaaaaaattggtccgatcatctaatatacaagttagacgatttcacgttatgttattacaacctacaacaaaatagactatgatcgaaatcatattgaatcttttacctttcaacgtaatacaaatctggctttacaaagcaataattcatgtttgtttgtctaatttaaatttccctgttttttttcccctctttctgtttcccatttgaaagtaaaagatcatttaagcacctaactcaattttattttattttaaacacctaatgtcatgctccttggctccttgtaattagttgatcgtttcaatttagaccagcaaaacattttagtatgttcgtaaatattgcgtacatgccatttcgtttgtcatgcaaacggtgtgtgtttctttacttagcttctagttggtgtatattgcgtcgcattaatatcggtttaccttcctcctgtctacgtaatgatatattctccaccacaaatttaaattcttattgaaatttcctaattttttaggtagctcaaggtctcaagtatactacgtaccctatttttttgaatatctatctatattataacaagagtttttctgagctagttaatgagatgacaatattctacataaataaatgaccctcgaaagtttcaagtactttaggatctgaccaaatcggggtaaaacattttgaaactaattacgttcacatctaccatcgatgattgacaagcttattgtcaccttttatgttaaagtgacatggtcttgacgttaatttgcatgttattctacatctatagtccaaagatagcaaaccaaagaaaaaaattgtcacagagggttcaatgttacttagatagaaatggttctttacaataataaatttatgttccattcttcatggaccgatggtatatatatgactatatatatgttacaagaaaaacaaaaacttatattttctaaatatgtcttcatccatgtcactagctcattgtgtatacatttacttgcttctttttgttctatttcatttcctctaacaaattattccttatattttgtgatgtactgaattattatgaaaaaaaacctttacacttgatagagaagcatatttggaaacgtatataatttgtttaattggagtcaccaaaattatacaaatcttgtaatatcattaacataatagcaaactaattaaatatatgttttgaggtcaaatgttcggtttagtgttgaaactgaaaaaaattattggttaataaaatttcaaataaaaggacaggtctttctcaccaaaacaaatttcaagtatagataagaaaaatataataagataaacaattcatgctggtttggttcgacttcaactagttagttgtataagaatatatttttttaatacatttttttagcaacttttgtttttgatacatataaacaaatattcacaataaaaccaaactacaaatagcaactaaaataattttttgaaaacgaaattagtggggacgaccttgaattgactgaactacattcctacgttccacaactactcccatttcattcccaaaccataatcaatcactcgtataaacatttttgtctccaaaaagtctcaccaaccgcaaaacgcttattagttattaccttctcaattcctcagccaccagccacgactaccttttcgatgcttgaggttgatatttgacggaacacacaaatttaaccaaaccaaaccaaaaccaaacgcgttttaaatctaaaaactaattgacaaactctttttgcgactcaaaccaaattcacgttttccattatccaccattagatcaccaatcttcatccaacggtcatcattaaactctcacccacccctcatacttcactttttttctccaaaaaatcaaaacttgtgttctctcttctctcttctcttgtccttacctaacaacaacactaacattgtccttcttatttaaacgtctcttctctcttcttcctcctcagaaaaccaaaaaccaccaacaattcaaactctctctttctcctttcaccaaacaatacaagagatctgatctcattcacctaaacacaacttcttgaaaacca

SEQ ID NO: 293 - DNA, 3000 bp, Arabidopsis thaliana
cagagttactctctttttctctttttttccattttttccatgttttaccaatcacactgccgttaaattatgtgtcaaagtaaaatataataagttaaaaataattatatatatattaaatcttaaaaaaaaacttaaaccacaatgaaatgacacattaacaacccaaaaaaaatggttcctgattcctactcttttaatacactttgatttttatacgtgttttcgtagttcattcgaactattctaggtagattaaccaaccatatgtaaatgatctagtcatcctcaaaattagtcaaacgctagtgcaatataaatttatgatcttagaccatctccatcaatctaatactgtgtgggtttctcaacaatattattttaatcaatctataataattaaattatttatttaaattttaaattataaaaaaagaattagaccaataatataaagacacgtgaaaagcagttctataagtttctcaacccaagaacggtcttctgactctttcttctacttttttattattttatatttttttttatctccagatactctatcaaatattactgatgaatatgctctaagggttaaagacccccatttctttaaaaaaaatagaccgcctttacagaagccaaattctatttttcagtacatgaagacaatattgaaattattgttttgacttttagactaggaattacgatgcttgtgccaactacgatattacaaatataattttctggtcaaatggaaaaaaaaattattaaaaaaggagagagagatgatttatcgataaaagtaaaactagagacaaaggtcgttgttattcatcgaccacccacatgtaactaactaaaatgagttcatttgttactatgtcaactaaaaccgttgacactatccaaaaataattttgaatctccttgttatgacttttgcttcaaattaagcaaatcagtggaaacttaacataatgattttcgttgagagaacatcagtctgataaaaaaaaagttctttatattcagttaatctgaaaaaactgaagaaacaaaaattacagcaacaaataaaaatacagaaaaaagatatatacatgaacaaagataagtattagtagtacactaatgttttgtttgagaagaggaaaaaaacagaaattagtctataagacaaaagtcgttgagattgtgttggtcaaagtgaaggcttcaaaatcatggtttaacagtttttgatattgactagaaaaatctttgtggaatgttactggtctttaaggctgccaaaaaattcatttatttcattcacgacattaagtggtccaatgtctgccactatcaacattactgattctagctttcatcaataagaaaattttgaaccatataatattcgcattaattcaaaagcattctaaaaatgtagagacagatggaattctacaattctatttaatacaaaagcttacacttttcatttttagcttattctaagctgtcaagtgcttagcattaattgtattgttattatgaatacgtgttttgagtgcattattgaaaagaaggtggagatctcaaccgtctccaatgagtgatttaggagtatatcttaaataatttgcatttttttggtttttgaaattttaacataaagaatcctataattaggttttaaaatcaaaagcaagaacatttctaatattaatgcctattaaaaggggcacatttcaactgttctgacctctaattcttgtttatgccgacatgatgtttgcagtagccagtaatatcagtatttttcaataaactctagctctttaatacaagatcggtaatctaggaaaagccccaattcttacatggatatttttttttgtcatcgtgacgatataaagatgacctaattggcctgacaaaatttacacaaattttattcttacataaactaaaaaaggtgaccaaataatgacaattttatgtgtaatattagaaaattgttattaaaattttcttagcaaatattgacttcgtttttctcaacgatattatatatatgaaattttatgtataagttattacaatcgcatgttctataatttgaacggataacgaaaagcaaaatttagatttcatttataaaataaaaaagaatgaaaattcgaaattcttgtttagcaaaacttttgaataaatgatgtggacaaagcggattaaaccactctatttctagagcggataacaaattacgcttatcaaatttatttctacgtaaaaatgatctgtagttaagctgtcgcagataattttttttttttttaatccgcattattatggattataacttatcaatggtaaccaaaaagcaactcaagccgcaaacggattcgtgcgtcccaagtgtcacaactattcgaactatatatgaagttatgtgtctgttagaactggatttttactattattattactattattattatcatcgattaaaggatgttttttgatgaaaaaaatatattgttctatttagccaacaaaatgaaaagaattccggtccattattttccatcaaatacaaattttaacagattctgatcttgtaaaattcaaattgatgtctcatttcttttccaaatactgaaattggacttaatgttatgtactctcaggtcccccacaatgatcactctttttcacaaatttggttcaaatccactccaaaagatacaaaaacaattcaaactttagggaagtcaaacaaaactataacaaacaataaggaccattttgaaatttctactttcttcagttctttcatggaactttcgttgtaatctatctacaacgctccacatactcggtgtgtacacctgaaaccaaacctctatatatagaacacaatctcacttcccaacacatcaaaccataacttccaaatctcaacagaaccaaaaacaaaagaaacctatattaaagaagaaacaaaaa

SEQ ID NO: 294 - DNA, 3000 bp, Arabidopsis thaliana
caggtgaatcgagcacaaggttagtgagccattaagatcgagaacacatcagagttgcatgttatgtccattgttagttagtttcactagaagaaaaagttagttttcatttgcttatttttccactgtacactgatgaatgcttggtgcatgaggaactattttcgttactgctaatgcacaatatggttgctatctcccactggttttttcttatattatccttgatgatgttctacaggtgaggcagaagcaatactagctagagcacaagcaactgcgaaaggcctggtcttgttatctcagtccctcaaggaaactgggggagtagaggtgagtaattgagatcaagcagaatattggtattcatagttttgatttaactaactagctttgattaattaattcttcatagtatttacacaaattgctaaatgtgtacgtctttattctctttggataaagggttctgtgtcttcttgaactttccaacttttggaattttaagtcatatcactattattgctgtgtttaggtttcttaactttttctgtccaaaatatgatctcatacggtgtcactgtaaaatttgcaggcggcgagtttgagagttgcagagcaatacattacagccttcggtaacattgccaaggaggtaaaaacaaatcaattactgtaatctcttccagtctcttggcatagctcgggcttatgtaatgttcatgttttttgtttttttttggggtttagggtacgataatgttgcttccaagtggtgcttcaaatcctgctagcatgattgctcaagctttaacaatgtacaaaagccttgtcatcaatggtccaagcaaagatcaccaagaaacacaagcacttgatgaaacagatttggaagagttggaagacatgggtgagaaacatatatcagaaggctctaataaccgatcaggctcaatatcatttgacacagagaaaccaggtcacaccggtgaaccacgattttctcttcagaaccgcaacaaggatccgcagtaggcagccgaaccggggatgagataaattctttgggcttgagaaaactggaaaccatttttcatctttcaaatatgaggcagtaaccatcttttccgtttgaatagctagaatatcatcactttgcatatagaaacgaatctgaacatctgttctccgataagaattttcctactggatttgttatgaacatggtccttgtgttcttattcacctttattcccattgcattgcttattacctgtacccgttattattcggttcggttgcagagtattgcaatctaaccaggaggagcttgtgaatccatgagatgtcagaatttgccagcagaaaagaagccattgccccctaaacaggatatagaagaatggtggagataaaagttgtcctccggataaataggtcctcacagagaatcaaaggtgtaatgacttgtgattctgaaattaaccaaaactttacctgaaatagctttagtccatacgattcctgtatgaatctgttcacagccctctcctccatttgctcagcctccggttataaaattaaagagttttggcctcttcaaagtcagctttgtctagaggagttctccttttctttctttctttttttgctccacagctcttcccattgtaagttttgttttccaaactaatcctttcaatccaaaaaccatgggagcctgtgcgagcaaacctaaggaatctgacatcgtcgaaggctctgtctcgaccgaaaatgctgttgttgagtccaagaatgccgcgaccgagacagatgccacattaactcaggtgagtccaatatattctttctaaataatttagtagatgatcttaaagattcttgaattgaataacatgaaatttaccaattaaacagaatttactacaaattcttgattgaacaaactcatattaagttaaaactattgttgctgattgttgattaaaggagaagaaggaagagtccattgaagagacaaagaaggaaggtgagacaaaagaggactcctctgaggcaaccaaggctgagccaactccagaagctgtgaaggcagaagaaaaaacatcttctgagactgagccaccagcacaagagaccacacctgctgctaaaaccgatgaggcccctctcgtgatcctttgattttcatttcatcaaatctcaaaatcatgagtatgtgcaagtgcaagtgtttctcacattgttattcgtatgttcatctctgttctattgtcaatatgtacaatacccatgtacattctgttgtgcccgcctctagtaaattatgattaacgaaaaattacaattcttttttatatagcttatgatgtgtaaatatcaacactaaaactgggacattcagttggcaccaagtagatcgatatctagactagaggttcctcctctatgtcccacggttgcagaggataaaatgaagaatgagtacatggcctacaaaatcttggttctttttgcatgtcgattccaactaccacgcatttatagcaaggatattaaatttccggtacggttttagttggatttcggagaaggcaatgtacacttttaccgaacaccccaagttttattggtcgtaaacaaatactacaggccaccatggatacatctagtgcgcatctatatcgaggctcaattaaaattttaacggaccccaatcagacgtgtctacgcaaggctcaatcgaccagtaatacaactataaataagcaatcaaagcagcaaatgggaaaaccagcgttatgttttggtatgagaatcatgtcagcaacaaccaaacggtgtatatattaataactatcgagagaacacaaccagagttaggtaggccttgttagattttcacaccaaaccctggcactatatatagacccatctagtatccaaagcataatagagatacaaagaaacaagaaaacgaaaagaaaatatacagaa

SEQ ID NO: 295 - DNA, 3000 bp, Arabidopsis thaliana
tatagagcataatttttaaaaataatatatttccttgaccacatgtatatatctccaaaacaatagtaaaaaaaagagagacgaaaagaaagaaagagagagagccccacaaacaaacaaaatggatttgaaccaaatcttgatcctctcatttctctctctttttaccttagccatattcttgctcacaagatccaaacggaaactaaaccttcctccgtcgccggcgatctccttgccggtgatcggacacctccatctcctcaagccaccgcttcaccgtaccttcctttccctttccaaatccatcggaaatgctccggtcttccatctccgactcggaaatcgcctcgtttatgtcatctcttcacgttccatcgctgaagaatgtttcacaaagaacgatgtcgttctcgcgaaccgccccaagttcaccataagtaagcacctcggctacaacgccacctacttactctcggcatcttacggcgatcattggaggaacctccgccgcatagccgccgtcgagatattctccactcatagactcaattcgtttctgtatattcgtaaggacgagatccgacggctcatttcacatctctctcgtgattccttacacgtatgatctccttcaattctttttatttattatttgttctgtattcattactttatctttggtttgtcaactaacaaatttattatttattcattactcgtgacgactactttcatatagtacatacttttatatttattgtggtgataaattgtccatgtgactagtttatttttttgaagcattgcgtgtatattacgatactagctatttattcacgaaagtctgatcactatattcataaatattacatagtttattcacaaattacaaatgtacagaaaagcttaattttaaatttatagaaaaagatgcagtgtaggttttaattgtcttaagttggttgaataattatttggttcaaaataaacacattgttctaatatgttaaggtggcgaatatggaaatgcacaaatttttacatacttaccaaaactcttatctgtttactaatattgtattcgtactctcagggatttgtggaggtagagatgaaaacattgttaaccaatttggcatccaacaccaccatcagaatgttggccgggaagagatatttcggtgaggacaacgatgacgctaaactcgtgaagaaccttgtgtcggaggcggtgaccagcgccggtgcaggaaaccccattgattatctttccattttacgttgggtctcgagttatgaaaaacgaatcaagaatttgggaaataggtttgatacgtttttgcagaaattagtcgacgaaaaacgtgcggagaaggaaaaaggtgaaactatgatcgatcacttgcttgctctccaagacattcaacctgattactatacggatgtcatcatcaaaggaatcatacttgtaagtatcaatcaataagaaagtttttatatatatatagagagagtttaatgattgaaattttgtttagaccctgataattgcagggacagatacgtcatcagtaacactagaatgggcaatgtcaaatctgttgaaccatccagaaatacttaagaaagcgagaatggaaatcgatgaaaaagtcggtttagaccgattagtagacgaatcggacattgtaaatctctcttatctccaaagcattgtattggaaacactacgtatgtacccggcagtcccactactactacctcatttgtcatcagaagattgtaaagttggaggctacgatataccaagtggaacaatggtattgaccaacgcatgggccatgcatagagatccagaggtatgggaagatcctgagatattcaaaccagaaagatttgaaaaagaaggagaggctgagaagctaatctcatttgggatgggacgaagagcttgtcctggagccgggctagctcatcggctaataaaccaggctcttggaagtttggttcaatgttttgagtgggaaagagttggtgaggattttgtggacatgaccgaagacaaaggagccacattgcccaaagctataccattaagagccatgtgcaaagcacgttctattgttgataaactgatataaatgttttacgttgaaaaatgtattctatttaatgacatgtttttaattatgtgttttggtcttcaattcgtccttcaatcttttgttgtatctttgaatcttgcttaatatcatcgggtcaatgaagctgggcttgctcaccgggttagtgggctggctcttgcgttgttggtccaatgttttattgattgatatattttttaatgtgattgcattatagttaggttaaatatagtgtttttaatgaagttgtaaaatcaataggtcacgttgagtcgttgacccgtattttatacttgacccgtattctccagtaaaacgtgaagaatcgtaaaaaaagaactatcatatagtataaaattcacatcacataaagtcactacagattcgataataaatgcattgagtcttgtgattctatattttctattcatcgcccccaattaagctacgtaataacagggacataaattgtctttttaatagattttttaagtcggcaagtactgtcttttagatatttcggttgtcctatgtagaaggtagatatgtaaagggtagattaaaaaaggaaatttaccttctacatcctatttagtatatttactatactaaaaaaggaaatttacctaactttctcattgaaaattagttattaccttctctttcaaaaagcagatcaaaatctctatccaaccatttccaaaaattcaagtctctttagttttcagtcaattaattttcgtgttttaaaggccacaaagtacccatctggtccatctcgatcccacacacgacacaactttacacaaaaagaaagaaaaacccaaaaacaaaagaagcaatcaacaagaaa

SEQ ID NO: 296 - DNA, 3000 bp, Arabidopsis thaliana
tgaattcataaggatggtttgatgttgttaattgttatgaacacacaatttcttataatctcaacatacttgtaaatcaaactcaattacaaattgagtgtttataaatacgaacaattggacttagccaatctgggggcatcgttgcttaatacaaaaacacataaggaaatgtggaagctctctctttgtgataacaacagctagtcgttctctttcatatgttaactagtcgcaaagatagttcatggatgagaactctccaatgggtataaatcttagcagtgatgtcaaggatacgttggatgaaggagcatatggagatagcaaatttgggttgctggactgtgatcttgaatgcacggctcagaaaatcttgaggaaaagaccggtcaagcgctcgtggtattactaccatcagggactagtgaccaacattacaacttctttactcgatctcatcctttgtttatgtgtcggtcattgagtctctctcccatccaactttcaaaactatatgacccaaaaagtcgtcccttgtaacatttaaatttagtgaacaatcaaatcaaataatatatatattaataagatccattaaatttgggttttcttacgtgaaataaagatgaaccacgaattttacctaccaacaatattaaaaacccgacaatacatggtatttctgtatttaatccacaaggtccacaaccattccatattcatattctctctttaattaacgtttgctttctcttccatggccaactcccacgtggcagttctcgcttttccattcggcagtcatggtcaggctatcctcgccgtcacccgtcgtctcgccaccgcagctccttccaccgtcttctccttcttgaacacctcacaatccaacttctcgttgctctcctccgatcttcctccgaacattcgggtccatgacgtgtccgacggtgttcccgagggatacgtgctctcgaggaatccacaggaggcggtcgagctgtttcttgaagcggcgccggagatttttaggagagaactcgcggtggcggagactgaggttggtaggaaagtgacatgcatgctcacggatgcgttcatctggttcgcgggggatatggcggcggagatgaaagtgtcgtgggttgctttctggacctccggaactcgctcactgctcatctctacacagatctcatcagagaaacaatcgctgtcaaaggtttatatatattccaaccttgtgactttgtcattagacatgctattaaaggaaagttcctaaaatgggaaacaaaggttaaaagaattatgtcatttttaccaaaaaaagagacaaaaagaattatttgtatatgtcactataaaggttattcaaatttaaataaaagaaattacaagattcatatatatatatatatatatatatatatatatatatatttttttgataatgatatgatcctttctaatttacataagtagatgggcgtatggaggaaacattagggtgtatttctggaatggagaagatcagagttaaagatacaccagaaggagttgtgtttgggaatttagactctgttttctcgaagatgttgcaccaaatgggacttgctttgcctcgtgccactacggtttacatgaattcttttgaagaattagaccctacattgactgataacctcagattgaaattcaaacgttacctgagcatcggtcctcttgcgttgttattctctacttcgcaaagagaaacaccattgcatgatccacacggctgcttggcttggatcaagaagcggtccactgcttctgtagtttacattgccttcggtagagtcatgacaccgcctcctggagagcttgtagtggtagcacaaggattggaatcgagtaaagtgccttttgtttggtcgctccaagagaagaacatggttcatttaccaaaagggtttttggatgggacaagagagcaaggaatggtggtcccatgggcaccacaagtggagctgctaaaccatgaagcaatgggtgtgtttgtgtcgcatggtgggtggaactcagtgttggagagtgtatcggcaggtgtaccaatgatttgtagaccgattttcggggatcacgcactcaatgcaagatccgtggaggctgtgtgggaaattggaatgacgattagtagtggagtcttcacgaaggatggatttgaggagagtttggatcgggttttggttcaagatgatggcaagaagatgaagtttaatgccaagaagcttaaagaactagcacaagaagctgtctctacggaaggaagctcctttgagaatttcaaaggtttgttggacgaagttatgaaagtttgaagcaaatagactttggataaataaacaaataaacatgttctgttttggaatgaaaatgaaaagaccttttttgtaaaaaaaaagtgaaagtgagaatctttatcctttgtttttattttttatttttttctgttatggtaactttgtaattaatatatacatatctaaacaaattgtatgtcggtagatatatgttttgagaaaaaaatatctatcgtgtagactagtctccatataaaaaaatatctatacgtctgtcgatctaggggcttactttagaacattgaatgaaagacagatgagacttgatgagaaaactcaccatataatataagaaccacaaattctacctaccaaaacaatatagcagggacataaacaaaggacaaaataaaggtatacttaaatttgattaagagagaaagagtctatacttgctcggtggctcatctacgaactctctttagcgtacgaactctctttagcgtacttctatttaatgtaactacgcacattactctctctttagcatacttctatttgattaatgtaactacgcacatttttctctctttagcgtacttctatttaatgtaactacgcacattattctctccttagcattgcctgcatc

SEQ ID NO: 297 - DNA, 3000 bp, Arabidopsis thaliana
ataccaaaaacctaatgaaaaagttgcattcaaatattctaataatttttttaattgtgtagttttaaaaaaataatataaatgcaacggaatatcaaaagctcatgtttactttctttctttctttctttctttgtgtaccttgcgctacaattgtttttgctcaaacacaaacaaagtattactttaaatgcaacgcaaattgtgctttgtcgtgaaacaaacacataagcgggttcccttacttttttacgacaacacacttgtaacacttacgtacaattaatgaagagaatactaaatgtcatcaatcatgttttcactttttaattttttatgtatatccaacatacataatactttttttttttttgggcacatccaacatacataatacatatagatttatatccggataaattctggatggaaaataaaacaaataattaaagtgtcattccaaagctgctagatcacaacatttggcttaaagcatgtacttgtattgtaatgtaccgtaaacaaattatattaattttatgaagtgtataatgtatcaactaaattgtcactttgaatatattctctatattaatacgatacaattaataataccagcatgattgcacatttgcacgccattcttgatagataaattccgtttgacaatcatataatataattaagtatctatatactataatacaaaatttaatttgatgaagaagtcgtaccacggcactgctacgtacaatgagcagcaagaggcgagatcttatgccgcgtaacgatgcaacttacatatttattcaaccgcgtatatatgtttcttgttgaaagacattaaatttggaatcgttctatgattaatttccccaactatatagtcactgaatacttttcaaatttaagatttttgtatttattaaattatggggagatgtggatgtttcttgaatatgaaaagtcacatatatattcttatcttcaaaaagatttatatggaggccacaaccttgataagacaaatgtcactaaactatgtgttgatcataagtttgtcgatctctgaccgattttgactgcctcaacattaattttcttgggtcaaagtgtatagttgtattgtgttcgtttgcgcttcgttaaagtgaaaatatgttatctttaacttctggatccattataaatattatcactattagattctagataaaagtagaattttctaattaagctataaaaaagttcaagatttacacaatccatgcatatcagattgttccacattaactttacgtactatagttcgtaaattatatgtaatcattttttggggtcaaacttaatatgtaatctatggtggggcacatgattctatatattttaggtgaaatagttgttaaaattaatatgtactacttaatgtattaattttacaagatgtttggtgatagttagacttctctaacttccaaaattaataaggacgtagacaaataagtattcaagtctttggtcctagatccctcaagaaattttatgtttttatttcacaggcagaaagtcaatttgtattatatagatacaaaacaaaagtcaatgaatattaaaactcttatcaaaactataatacttatttcatcaataatttttgtaagttaaacctacttctatgatttgaaaaatgaaagtcacgtttagcaaaagaagaaaaatgaaagtcaagttttatttttatatgtaatctgattaagttctaagcacatatataggttttgatttttgttggggtcaaccacataggttttgattaattcgtataagctactaataaagtaataatatatggctgtaatgcagggcgaacgtgggagagaaattagtatctatgaataattaagttagtataacaagtgggcttactattactgacatatataatcataagctactagatcataagtaattagtcctgaaaacttggattatctgtcttttgttttcaatgaccacacgtgggttttcccattaccgtttaatcactagtttcagtttttctttagtgcaaaagtaaaatttgttattcaaatgacttattacgcatagaattataccagagaataatttagtatgaaccaagtgaaaaacataagtccttttaacttaagacattttttcagtcaaacaattgtaatcatttgttaaaatgacaaatatatctaatgctatatagtaattatgaatatgtcaaattgtcttcctttagcaacaaaaaaagaaaaagaatgtcaaatagtcatttaaatattaattttaatctttgtaaattcttaaaacttattattaatctttttattttttaacaatggggttttaataatttaaaaactttttagaaaactatttcgttaaaaatacaactctaaatcttattttcaagatactcggacccaaatcatacatacacttatatcatcattcattaatcactattgaatcctaaacagagataaacacaagagtgttggacttggttttaaagaactaatagtataattccatgaagtgtatagcgttccattaacatggcaaaacatctaataaaaaaaaaccgcccattacctcctttcctttgtctatacttaagggccaaaattgcccctttccttgacttaatccataattaattaaagaggcataatttaattaacggtggctaaatttttggtcaaaatctcacacgctccttttttttttttgcatgctcttggacacgtgctctcgtcactctctctcaaattagctggctccaaaaaaggttccttttaggaaactcccttctccaatttgtttcctcatccttctctctcctccactgcctataaaaccaattcatctctcccacttgatttttcatctccaacacaaaaaccaatccattagagagagaactcacaaaacatacttcgaattcccattgtttaaaagacgaagata

SEQ ID NO: 298 - DNA, 3000 bp, Arabidopsis thaliana
caagtttttgggaattgctaactttgcaaccacgtatatgtgtacaattgaaaagtcacatagaatgacgactgcatagacctatattattaaaaaaataaaaattgtccattttgatcaagaatgatggatcataatttgatgtatatatacgtatgatgattataaaatcacatattttgggagactcacgtacgccttgaggagaccaagaccaaccctaaccccaaagcttaatcgctttagcaacgacaaggacaagacaccacttacttctatggaatctttaccacaatgtgtgtaataatctaacagctgagtagaatttgctcacactgatactacatacaaaatctaattgtatcagtcattcacatgtgaaataatgtatgatttaaacgaaaattatgtgtataataattaacgtaactgaagataaaaaatataaaataaatatttgcttattttatgtgtgttaattggagataagaaaaaattggtattttatttgaaatcgtggtagaaaatttctcaaaagtcgtactaatgccttgagttttgatcagttttgagtttttttagtttttttttttctttttctaattgtgtgccatttgtagtgtttaggtgtcttttatgtgtacatagttgtctatcgattcattcaagttccaaactgcttttagagaaaaaaaaaaggggggcattaattggggatgttatcgacataagtatgtgtatatgggatgtgatgagagatttttcattgctggatggagctcaaatttggcatatactagaaaactgagagagttttatttggaggtggtttgagatcattcgaatggttgaatacttttttagaaaacagattacttttgcgaaatttgtttgaaaacaaatttggcatatactagaaaacagattttgaaccttttctctagtttaatctaatcatgaattactttacagtttcttttgtgtttagagattgacaccatattcttcttgatgctcacgtttctctttagggtacatacgtaaaactctacttcccctttggtttccaagattgctttcatctccatagcttattgctcattcatcgcctaacaaaacattacacgaagcatgttgtttaatgtaaaccaacatcatgagacaaagaaatatgtcagtaaaacaatagatttcagtcactctatatctaaagatttaacgacatgcttttgatttcccttgaatgcaagaaccagttctttcttcacaggagtaatcacaagtttctgaaataacagagaacccatattaagaacaagctatagagacagagatgaacatgttgacttgattacctctacttctttaggttctggaaatttctctcagccacagagcaacttttcctacctacgggttttgatcatcaattctctagctgtcaaacgaaatgaagaaaatacaagataaaagtaagtttcttaccgagtgggcacgtaagtcgaatgcagacctatctgctataccaacacattcaatccacccatatgaactctcaaattcagcatccaaacaatctgcagcatagcgggccatttcatttgcaaaatgctggcggaaacgcaactgttccttgtctgtgccaagacggacaaggaaaagatacactctcgcaatgaagtagcctacagtttctttgttcacagttccctattcaaatacagttgcaggcatcaataagcaattaagaaacaaaaggtctgagggagtgcatactagaagtaagtagacgcagatgattacagatactgaccttggcaacaacttcgccaaggcaaagttttttcgcagattggccagacatttgttcctctcttggaaacataaggaattcaaaatttgctacatcagagaatttcggatgtgacttattcccaggatcaacaaaatgctcaatttctgccagcgtgaattcacaaactctaagaagcccttgacgatgagatatctgcaagtaatatgcgtcacttattaaaagccagacataaaagaaagaaaaaagagtccctgattgagataaacacatccaatctatcaagcaaaggaatagaaaattaaacgataatcacctcatttctaaaggttgaccaatttgagcagcagcaaagggaaatttcctcccattgtagtaatacaagtccttcacaaaaatgccttgttagagtgttcttcgtgtctggagcaataatccttaagcaagtggtccgtccgcactgtaacaagttccagttttctcattcttaaccattagatcagtgaactggtctacatgtccagatgccttgagaacaacctctggtgtcacacatggacaatccacttcatacatattctccttaagaatgaaatgctatctgagaacaaacctaaaacaatctctactcttctctatgaatcatgtcaaatttgtctcaatttctactcaaaagagaaaggtgaatgatgttccgtacttacttgacgccagaagctaagaacattggatttaacagcacaatccttaatcaaatagtccggcgacgtcacggttgattttgaaagaagggatatagaacaaacgccgctcgagagtattaaccacattttgtcgaaatcagcagctccatggctgcatcaatcgtgaagccttgagagcttgaagacattcccctgagcttcgacggaggaagatttcgcctatactgatttccgccgtttgaatttgatcggagcattttgttttttcacaaactttcatatctttaacgacgtcgttagtactgaagaaaaaccctaaagagtaaagaccctaacggcgtcgtattaaaaccctaaaacggcttcgtattaaaaccctctgtcttataaataatctcttaaaaccctttcttcttctcttacattttcagctgctcataaaccctaaaaatcctctctttttctcaaccttgattcttagcc

SEQ ID NO: 299 - DNA, 3000 bp, Arabidopsis thaliana
cattcaatgtgaaagctatatatgaaataaaaaaatatcccaacgcattataattcaattagacaagtcgagttttctggttgagaaaagaaaaaactttaacaaaaaaaattgaaaaaagaaaagaaaccaaaatcgttttttccgatatatcgtgtgttatacgttgacaaaataggtactgatggaaattatttaccgacaagaaaataattaaatatatcaacgaattgacaagctaaataagctaaaggaccaagttgaggaaaaatgaggtccacctgcggaccaataacaactcgtccgtactaataatatctatttatacctatgttggatgtttcaaaaaaaaaaaaattagcatcataaatcagatactttttcctttagcactcttatctattttgtttctctataaatcacattctaaggtcttctacctcctttgctcaaaaaaaaaaaaggtcttctacctcttttttctaaaaacatacagtatataattgtagttttcttataaaggagtaaaaatatgataaaaagttctgttactcttttatcatataacaaaacaactttcactatctttgtaatatctataaaaatatgcaatgatataaattccaaacaaaatttacaaaacgtatagaagaaactaactaattctgatatgatcaaatcaaaagtataaaacaatgaaagtgtactggtgaaaatgtctctcttttgtaagcagaggttacacaacttcaataatgtatcacttacaaaaccaatttttcaatttggagctcaaatacttagaatcataaaagaaacatggatgagcccaatctctcttacggagacaaattccatgagaaaagaaagctgagttagcaacaagtgccacgtgacaacatactcaatttcttctaaggaaaatacaaccatctatttctttttgtcgcatacccacccatatatgatatacttagaaccattttaagtttttttaaaacataaaaatacgattttaaatttgaaaatttgattagagtgtgattatctaattattgtgttgtctataaatctacacagtcactactttctaccacactgattttaacaaaatcaattaaagttgatcagcacttatttctttcatatgggcttaaatgccaatttacttatatatattttgatgaaaatgtgtggtaaaacttaagaaacaaaaaaatcctaacactaattagcgcctaggtattttgagcaatgcctctttaacttaaaaagaaaaaaacgaaaaaagacaaaagtaattgtcctgctgtcaagaaatgcccatattattattcatccacacaagacacgtacgaccatgcctcttagtgatttgtcattggcccacttcccatcctagtggatcaaattgataataaatactataataaataattacaagaattcaaatagaaaccggcaaatcaattaatagatataaaaaggagatataaatcgttaacattttctattggagcagggagagccaataaaagtcgaatctcacgatatttcgcagttctctaattggctctttgcataaaaaatgaaacctaactaatgggtagaagaatacttttgcaaagcaacaaatatatcagataagatcgtaagctatccacatcacttgttaattgtcctcaaaccatattatataatgcaaacaatttatggcgttaaatccttacgtatttattctctataagagtaaaacacacacactgaaggcaactgatttaattggatttctattgaccagtagaaatacttgttatgatgtcggtcgctcgttggctaagtatttcttataaatatataagacatatttaaaatctttttacattacatacacccacttatgagaaacaaatataataaaatgttgataccaaatatatatatatatatataataaaatgggataattacaagaacaacaaaagagagattttttatgaatttggaattggaatctatcgagtgcatatattatacggacaataatcctcatagcaatacacattttttctataaaaagaaacgtaggataagattatagaaagaagaataaaaacctggaaatggaaaataaagaagatatatatcatgagttcatgactaaacaactatttatagctttttcaataataatatcattcaagagtgaagaataacaatcagatttggaagagaaaaaaatttaaagagagacaccatttaacatcggtaggatctgaacatggttatcaaatctaatactttctattttattatttttcatatagttattatcgttactatagtattatagtgaattaaaattttaagcatcaaaactcaggggggatgaacttcactaaaatgatgtcaatatctcacgtggaccctttatccattccatggcccacacatgggtcccacttccccatgcacacagcccacaacatattcatttctatatttgttcctatactctcttttctctttttcttacataaataaaatactaacttattataaggattattattgcttcgtgtgttttcttctataagttacatcaacagttcatgaaatagaccctaatatagtaacctaaattaaatgccgtatatttcattatgtttccacgaagcttcctttgtgttctttgagttgacccatacacacccatcttacttcccatgcacctgcacatatactataattactcccctcaaacacgcattcttacaaatatattttttgttattaccaaataaaaagtgaaacataaaataataatatcagaagtgacacttgctgtttcttatttccctccccccaagctctttctccttctttctatatatattatacacacacacgtatacatatacacaacataattcacaacacaacacaaacacatttctgttttctccattgtttcaaaccataaaaaaaaacacagattaa

SEQ ID NO: 300 - DNA, 3000 bp, Arabidopsis thaliana
aagaagccattgaagctaacacaagcgattccaggtgaatcaaagacattggagtatgaatctaacttaaccttggagcagtctggtgttgccaattccatgatctctgctacgtgggaatgaaatatcatcatatctataaaattatctattatggtgtgtttgtttcttaaggtttatcagattagttgtttaattgtttttaaactcgacttttttttatgaaaagaagaacacattatggtatttgatttgcaatgaaatggaaaaatcgtctattatatgtgcatgttaaactcataagcttttaatctctattcatttattaatggtttttatacataacggtaactaatgactatgagcttctattagatattataatcttttaaatccctattaatttaattggattaatgttagcttatactattagatttagtttatctttttaaatctctattagtttaattacattaatgattttaagactaaactgtcactatgcttattttagaccactaacaaccagaagctgagttgttatagcagattccggtagagcgctacgcgcactagtagcgcgtgaacgtacgcttcacgaaaacccaaaaatgtccgtttcacgttttgcaacccacggagacccaaatccgaatgtctcttggagacaagtggcatctatagactatagttgtgagaaatttagattctgaaaccaaatttagaaaaattacaaaatacatgcacaatgtacagataatcatttggtaaaaatctaagcattaattgcatttattaggatattagctgtaatttacctgtttatatagaaaaatataatacattttctcagtcaacaattttttcctttcctttttttgggaaaattagtcaacaataatcataatatgtgtcatacatctgtgaacacgtgtacgaattaagagtttgattatcaatgtaaaatcttcttatttgtatttatattcacatgttaagtattctcatttactttttctaaataaaactactttaacagttatctatatatatatttagagaataatatttaatatgatattagcaatttttcagtaattaatgaaaagagtcagagttgttagcattccaattgaattgttatctatggaattggttgcatttcactttaagaaatttaattaattaattcatatttgaaaatattttatttaattaatattttattaaatatcatttctaaattataacgccaaaatctatttacccgtgtcgaacggtattaattaggattttttaccgtttttagtataagttatattaagaataattaaaacatattaaaaaagttattggaaaaatatattatacctcttgttgatacaattcctaatttttaatctaattaattatttattttaaaaaatgaattaaaaatacaaaacgttatttttttgcaagtgttaaaacgatacttattatgcaatagatgaaatacaatgattgtgattttcgtatatgaacaatagttaaagaagttatgactagaagaattttgaaatttaatacctactgatttttgtaattacaatgaggtatcgattatttcaaacgaattttttttttaatactatgtattatgagacagtgcaactataaattcggtggtgacaagaaaaataacccctgacatgcccacatttaaattattttcaaaaaattgtaatagttagttagattagttttaaacaaatcaacaagtatgacataaaatcatgtgatttaattaattttagtaatattttctagtgtgctctcatggttgtacgtaagctagtattcgaggttaaaaacaaaaaggtagaagaaaaataatgaagtctttggtagtttaaagacaaaaatcatgagttaaatggagagaaagagagaggttttgtcttgaagccatcagagagacacgagaaagactctgaggtggccccctgaccacacccgcatgtgcccacatttcaccgttttacaatgacacccaaaccgtaaacccaaacctcctttttaaaaatatttaaattgatactattttaaaaaaaaatgttttttatacctccaaaaaaaaaaaaaaaaaaaaactcaaccatgttataatttatttactagttgattttactatgctcctaaaattttactactaataataataaaaagtagaattatatatagaaaacaatttgttgtgaacaaaacaaggaaaaaataatattagatatttctataatttaaaatattaaagtggggtcaatgacaattaaatttctagagaaagatttagaatgcatttgttcaaggtgaatctcacattaaatcccattagttggttattaaataataacttctttttacaaaaaaatggatttctttcctttattagagaaaataaagaaagggactgtagctatatatatattgacctcacagaagactcaatcccaattattaaacaacaaagcaagagagagagagagagagagatagggttttttgaggtgtgtgtatttgtatatttatataaatattttagtgtggcttcttgttcttcatcctctaatattatcatcatcatctatctacttgggttctttctttgtctctgagttttagcttttttattgacctttttcttcttggtttcttctctgcatctcaaagactaaaagggtacaataaaaaaacaacttatactatgtcttctttctaaaacttacaaattaaatccaactctttggatttatatttgttctctttgttctcgtaaatgtcttctagtgaattttttttttcatgtcgtcaatctctatggcttcttcctgttcttctaattccccgctttcgttttcttctgaatcatatttgatttttatcttctctctcattttttaaaattattttttctttatggatctttgtagctttagcaaaaaccgaccagctgagaag

SEQ ID NO: 301 - DNA, 3000 bp, Arabidopsis thaliana
taatcctccaaatttgttacgataaatagtacaccaataataaatgttgaaactattgaggttgagattgtatcgtggtgatattgttgagtcatttgttgggaactggtacggagagagtacggtaccaccaattaatacatacagtttattggattttccatttatcaagaaagatccattttgttttaatttttgtttgtttgtttgtttgttaaagcaaatatgtttgtactgcaatgtttgtttacttgccttagcctttactttaggcttgcatgtctgaatatgtctattcatgtgtaagtgaaacatcttgacaatcctaaaacctatcgtaaaatataatgaacatggtcaatccactcgacatcaattagtcataaaagcctataaaattgatgcatttctagtttagtgtatcattttcaaaattcaaaagaggagattacattcgagtaagtgtcaaatatgaaataagctacgtgttaaaactcaaaagttaaaattgaaagaagccacgatcgagatgcttcttctcgtcatgcaaacgcatgttttggctggaaagctgacaaaatccgcccatattctttctcgctctctttatcgaactgacatcttggagagttttgcttaagaccaaagtgtgaaatctaaagacgaagacaacaaattaaagtaccatatcccatgattaatcttaagctttgtgagaaagtcaaggctgtccacaaagaacatgtcatctcccatcttttcttacatacgatcatgtgctcgttgcgtgtcctaaagttttatatgctttatttatttatttttatattttccccctttttcaattgtttatactttatatcaatctttagcatatgttcgtataaattatgttggtatatattaaagttacgtaagacaaaatttattagaattcgaaatcctaactcgacaaaacgagttaaattgagctttatttgattttctatattctaaaatagaatgactcaaagacaaattgtgtatatatgtatatatataattttaataacacaagttgtatgtggagaaaacgatgtaattataaatttggatcatattttcgatatagtatgaatttttttttaattttttttaaagattacaaaatttaggaagataaatacacgagtgagtctgacgagagaaaacgcggtttggatttgggtagcaaaagagacagagtgagaacagctgtaatttgaagtcactcatcaatttagcatcatcaccttctcccacactcttctgacttcactcttcgctattttcatttactatttcctattgacattttcttcgtaagtattccatattactaacaaaattcatgttgtttaatgatgtaagaaaacaagatgctaaaaggcgatatcgttcttcttgaatagcatttgtatgtattatgtaacatgttacgttatggtgtataattaaagattaccaaatgattataatactatcaaacgtatttatactaattactgttttgtacgacatctccattttgttaacgcgtaagttactcacaattcacaaagcgatgagccacgatgttaaaatgttaaattcaatagcaagttgtcatatagctaggtttaaaaccagatttttctttagactttgatgatacacgtaacaaatctaataaaaagattagatggatcaatattctagtaataaaaaatattacaagtaataacattttcgtgcacgtatgtttgcaggttttacagtcactttttcataaaaatatataaacatgatacagtatatatatatttggtgtataactacaaatatacacactagtttaatcggtaaagaataaacatagacaaccaataattaaaccataaatggggccactttcttggaaagttcgtattacgagttaacgcgttaaaacgcagctgtaattcgtaatctcctgatagtgatgataggtacgtatatagtcaatatataaaagaaaattgatatctcacaacctaaaaaaatactataggatattttagcatcactcctcgatttgctcatcaactggcgtccgtgtgtataatatatatactctcctggttaattaattcctagcaaaattgactccaatcggtaatttattttagtttgatagtttagttcactcggtttatattttggacaaattctagaaagaatctaacacgttaataaacttggagagaataaatctaattgtaaaatggacccttgtgaaattaatgttttttgtcatttaaattgtagaataaaaaaatatacatttttctttgtaacaagaacatgcaattgataaaaatttacgtgatcgcataattaattgttgttttgtggttcctcaataaaaaaagccaatcaaaatcattatacgtttatgtatttttcctctaaataccaagaatattagttatacatgatttattttttataagaaaatgcaaaaatagcaaaaggttaagatgaggccatgttcaggttcattgttcgaacttcgaacaattgggcaaagccttaacatgcatccatattcgaataaataactaagctccaaagatttatgttcactagtttctttttttttctttttttaatttgaatggaacaaaaatgtattaatgccaattgctaggataaaggaaaaattagaagaaaaacacctgtcatgcaccacaatgtcacattcatacacaagaaaccatactatatttcatttgaccctattttagatttatatcaataaataatatttcatctcttcctctcccatacccctcccaaatcaatccatctctatatataatcttctcagctcacactaatcctcatcaaaaaatctctatccatccacaacaacaacaaaaactcaagaacaatatctccacttgatcactaccacattgtccaatcactctacaaagcctgtacgtacacaacaacattacc

SEQ ID NO: 302 - DNA, 3000 bp, Arabidopsis thaliana
attgctttttggaatatttatttgtttttctaaatttggttcatacaaatcatgatgttaaaataattttaacttgattagtttaccgttttccgttttttggtgcttatatatgtttatttttaaatgatgaattgtcgatttctgaagaggtcatattcctattatatataatattattgttgcaattgttgtgtttccaaacgcagaccaaccggttagattgatgttcagctctggtcccttatgattcatccaccattatatggttttaccgggtttaccaaacgttagttgtttttctattttcgagtttcttaaatactaaatgatttaaaatattaattaaaaaatacattgtaagttgtgcctatgtattggctgaataatcttaggacactgcataatttgctctataaactgcaacaaatatttgtttgcaaatgaggaaaatagaaatgttagttttatcaaatttcttgacatggtaattgattttctcaaaattattcttaacagatatgacgttgcttttctttttgtttacctcgtatttcttgacatgtatgctttgatgactatacatctttcctgtgctactccaatttgattatagatctctctaggacattaatattatcgggtatatgtttatttactcttatgtgacttaattgttattagatatctcagacatttcttttgcatgttcttggtcattagccgtagtatgtcatatatatatatatatatgccttgtatcaatcaactcatgtgcataccaaaaactactaatcacattgcaatttatatttttggtagtgttgattagtaagatacttggtggtacaccatttatcgcaacaataaagagttatcaatcagaacagaaatgggagactgctatatttatctcgaggtctatcttatatacaaacacctaattactttgaactctcgaagacaatgagaaatattcttacgaacacattagctgtagtattgaccgcgatctttatgctttccatgaattggtgaagaattgcttccttgtggtcaaaatgtatgtgcacaagaacattcgccgcttgaagcaagaaatcatgttaggtgtcgatgataaggtttttttacttcttccggatttacatgaataaagcggtgaaccataccatattcatatgattggggaaggcgatatacccaaataaacaaaactgtgaatcattatcacaagatcgccttgccattaaggtcgtgatgaatgtgtctttgacgtgaattcagattttcatggttataagaataacctaatctattatcacacatgagaaactaaaaataggtaaccacaaattcaaacacaaaattattttattttattattactaaagtaaatgaaagggaaaatacaaatatcttaaatatttttagatgactaagaagcccaaggaaaacactgaggttggcctccatcacgtctatcacgacaaggagctggctcataaatactccatatacattcgctgcaaactccatatttaccgcttggattatcgtctctatcagctctaaaaatatcaaacgtagctgtattgccgggccactcgaaactgcaagtgtatgttgttgttttacggagattgacacgaaacctgaaatcaaaacgatctagagggttgagtcttattacccctaaatcttcccctttgttagtacaatgtacaatcaacgttgcacgtgtgaccaatttgttgatgatgataacatgtttacgtgcgaatggtaaaagcccatcgggggacgagtgatttgttaatgatgctgacgttttgaggataaagaaaaataagaataatacaaaaataaaattttgattggttgagaaagccatgagtgtgttttacttttaagaatttgtgagataataatatttgttctgtttcagaagcaagaatttatagatgaaaatacattaaatgtgttattatttttaatgcaaattatcttctgggatatacgtataaatctttagtttgtaacgtaaaatacaattacaagcatactaaataaaatatatatttaatggtttctatatcattattctttggcaacaaaaatggtcaaatttatggaataatgcaatgttagtatgaaatggtttctatatcattatatttaattattaacaactatgcaatattagtttgaaattgtaacgtatgtgatactaaataagtgcatgaatcacgcgaataaatcaaattattttgaaaaactgttagagcaagatctaccttaaaccacaatttattgatttcttttctagcaacaaaacgtcttttatcactctaaaccagcttcaaacacatcgtgcacaacaatgtgtttgtatctcacgatcacgcatgtgagaagctaaattaccaacgttgtaaatttttctcctattagataaataatatagagtaagagtaaaaataaatggtccaacatggtaaacatagcactttaccaagattttaaccaccgcaatcttgatatcatctcgaggagaatgatgattgttgtctcgtcgctagggatgacaaggagaaaatagttatcgatattttagttatttgtatagaaattagtttttataatcgatgttttggttattcatattgtaatatctgattttgcttaccctagcaacaatttttttagtagtcaatattttggttattcgtatagaaaccaaaatattttgtactcattcacaaaaccacattggaacatctgtaatatagcattttgaactgatgtatggcagctggcatttttgtaaatgttttcgcattattgtatttctaattttctgtatgaatattccaaaagaagttgtacattttaatgagacgtggctgacaataaaggaggcaaatctttttagtggcactgaaagagagatcaaaaagagcatgaaaagagatagcaaaaagcccacttttttgcaac

SEQ ID NO: 303 - DNA, 3000 bp, Arabidopsis thaliana
atcatgattcatgaatgtattttttattctgcgaaaataacttagttgaaaaagtggtttttaaatccttttagtcttcatatagtaagtctttgattcttctaaatgtcaaaatgaaatggaataactcaaaaacttgtaaaactttagaggttttatccaccattgagaactaagttagttagttagttctcaatgaaattagatgtcgagttactggtcccaagttaaattttatcataaagatatgatttacacattattaagtattttaaaaagttgatcgtagatcaagcgaaattattagccaaaattatgcatttgattaatagttatccccaaaatttaacatgtgagaaagacgtaatgtattatgatttaaccacaaatttaacaatttaaaaatgcataagttacttgacaattgacacacatgcatgcacacacagaggagagagttctttttcatgagaaacaagaaaacgaatacgatcataagagaagaagttaataatgtgaagagtggacccaaacatttaagcccaacgcgtattacccaaagaataatgactcctctaacccaaggccctacttgaaattaaccaatcaaaatactcattttcttcccatttctgattgactaatattctaatcctatatatatgatgataatatgagtacttttttacccattggctcaactaatatattttacgtatattaaatacctactcaccttcagtttaaatttatccagtctaaaatatagaaatacagatataattcaaagttcactttcaaattacattttttcttgtcatacttttaaaaccgagtaatctgccaaaatatatatatttaaatatcataaaacgatactaaagggtttgagaacattagtttgaattaagctgataagtattctaatatcaacttctcaaagtcgaactaacccaaaagataactagataacacttttgagtttgtctttaaacgtacttttatcatgtattacaagtttggtgtgagtgagagtgttctttatccagaaggcaatgcgtgacccatgcatgatgacacgccgacagatacatttttggttctctgcatcacatatatccacctcacaagtttcatgttttcctttatatacacatcaaaatgtgtcttacgtgcactgttttgaacctggatccaatccatacataacatgatgaataccacgacgacactttagtaatccacacacatgttttataatgcagaaagtaaaattcaaattcgagatatcatgattacatcagcctcccatgagaatttgtagcagatacatccaattgcttaattaatatatgtatacatatttcttgacgcgttatataaaatccgtattattgtctttatttggataacgtgttaccaaaaactcctttaatttatgacttttcaaatatactacatttagattatcaataactataataaaatttagaagaacttacacaaaaaattactacagaaaatatttaaaaataataaatatccccgtttgttcaagatgaaattttgtgattttccagagaattcagtaatctgaattttaggtccatcatcttcagattattctaagtcatttctagtgggacactaattaaaacatcattttagtaaagttttgcactaaaaaacttttccaaagaacactaaaaagtgacatgagtgtgatgcaatatcacaccaaatttggtgtaacactagctgtttccggttaactgtttgcgtcaaataaagagtaaaccgtccggtttgaactttgaagagcgccgcgtgaagaagtcaaatgtcgttgctctttgttttagtcaaatgtagttcgtctcccacatcttactgtcataaatataatattaatctatcactagtatagttgtaccaaaaatgttggctccttgcatttagctttgtttatttgactgtggaaacttgaaatagtcttcttttataatagtcatgcaccgtctcagacctcttattagtcctaaattacctccaccttttcaatatgaataactgttcaaaagctttgagtggtaatacatacatttccgcatttagattcttattcctctctttaatcatggttgatggttgcatacccaaccaaaaaaacaggtaaatatcagacgaatatttttcttttaggctgttttagaatttattttaccatcgagcaaggtcgaaccattaaattgtttctttagacaaagcaagtctaaaactagccaacgttttattttacatatatcacctaatttaagtgatggctcaattttctaatgtaaaagtaagaagaagaaaaacgttttcgaaatgaattgatcttgtagatagatatttccgaagatgctttccaaatcaatattggttagttgttatagactttctttctttttttgtcaactggttagttgttataagttataactatctatctatcttaaagtaaaccgaaacgtgtaccatacgagtaccatccatgacaacgaccagaaaccacagaaactctagaatattttgtaaggcggcatcagtactagtaaactaagtaatgaaggaaaagtcttatagccgacctcttcttcattttaccaacaccacttgcacacacacacacgtgtactaggtcaaaccaaacgtgccctaattattttcctctctttacccccaaaaaaacatctagatactttcatcacaactttggtccgcatattaaaaagagttttagaaaaatatagtaattatctaatcgccaccttcactcttcacactttcctaccacttgtcacgcaacttccttctccacactccacctactactatatatttacacacactttcattacttcttcttcagcaattaaacaatttcttcactgcaattcacaagcaaccttcaaactaaaactcgagagacaagaaatcctcagaatctttaactta

SEQ ID NO: 304 - DNA, 3000 bp, Arabidopsis thaliana
tagtcgaacccgcagaataagtaaatgttttttgataatttaccttaaaatatccatgttgttgatggattttgaatcctatgcaagattgacgagtggattctgtatattgtaaggtagctagcttttgaacctgtccgggaaagctatcacgacaatctcttgaattactccgataatggacaaatgtttctgatgaattttgatgctcacataaaactgactaatgttttaatatgtggttccatgagcttcgtgatacggtgcaggtgagtcttcacgattgttttgcagtttttcttgttggtttaggactccacataaaccattaggatgaaattttatgtacacattcaatcttaggtcagttccttgattcgaacttggtttctccaaaattcttcttttttggtttgatacggtttggttgatgtgtaaaccggctcatttttggtcaacttcggatttgggttctaatgtccttttttttttttttttgttatatctaatgtccataatatattagtttggtaccacttcaaatatgatatttaagactataacgttgatttggatttggtttaatgtttctctatacggttctgttccaattcgatacttttgattcgagtattttgtccagagctaacagtgatcattaactcctaactattatggtaacgaatgtatatagtcaaaacaaaagttttatattactattttttattttttattgctaacttatttttgttttattcttttcgaaaaacttaatatcgatatttcataccaccaaatttgtattgtaatcattttcgtatcactagtcaactatcgcatacacggatcgagtttacatatatgtgagtggtagaattaaaccaaaaatactttttaggttaataatgttaaaattcaagtggtgactataaaacgattgacgtccaaaaaaagagataagaaaatggaagatggaagctgatggggtttttgtcggccaatatttgggtttatctttaacccatctctctacgtgtcccttctcttgttcttttcttaagtgacgtgtcttcgttataacttaattattactacttaattttccacaaatacgtttgactctttcgtgaattcgtttttgatacttcttaaacctatttttgaccatcccctcgaagtagaaacgtaaacatatacgaatcaaacaaattatgttcactgtttaatgatgcacaggagaaaatcctaatcatgcactgcgagaacgagtttaaattaaatgattcaacgaataagcattgttcatattcttgacggatgtaccaatacttgaatctagagatgttgtggtgggtagaaaagtctagcccgacctgaacccaaaaaaaacccgcccatcaaaaacttaactttagaaaacccagatgagtttttgatttagtgggtaaagcccgaaaaaacctgattgttccgagactatccgtgggtacccaacttggtttctgtcattttcttagagtttatatttaactgctaatatactattatatgtatattgtatctttattttgcttataaatatattttaaattgtatttattttatgtattatatatatatttaatgggaaaaaggtttaattgcgtttttggcgggaaaatgttaaattgcgttttttggcggaaaaatgttaaattgcgtttttggcaggaaaaatgtcaaacccttttcttgggcggaaatgttgaatgtcgtttttggcgggaaaatgttaaattgcgttttggcgggaaaatgttgagtgtcgtttttggcgggaaaatgttgaatgtcgtttttagcaagaaaatattgaatgtcgtttttggcgggaaaatgttaaatcgtcgttttggcggaaaaatgttgttgaatatcttttttggcggaaaaatgttaaattgggtttttgaccggaaaatgtgaaatcatttttggcgggaaaatgttgaatgtcgtttttggcggaaaaatgttgaatcgcgtttttgacgggaaaatgttgaattgcgttttggcgggaaaatgttgaatgtcgttttggcgtgaaaatgctgaatgtcgtttttggcgggaaaacgttaaattgtgttttggcgggaaaatgttgattgtcgtttttggcgggaaaatgttgaatgtcttttttggcggtaaactgttaaatcgcggttttggcgaaaaaatgtgaaatcttttttgaagagaaaatgttgtttcacttgaaaaaggactttaaaaaaatatgtgggtacccataacccaatgaggtaaacccatatgggttttatttatttgggtactcagcctattttaaacctatgtttttttctaaaaaaagtagatctatggacttaaaattttatgtgggttttgggtatccagtgagttttaacccatcattaacatctctacttgaatcaaatttaaccgagaagtactggaccaaaaccaaaccacttgattaataggagagcatctaactcaagataacattttgtattagtttatgtggtcctgtgataccaacattcaagtctctgtcataccaaaacacgggtatttgtcttaataagcaacttaggaataatatatgaaacaatcatcatctatgaaaataaaatatttatcaagagtttgaattattgaatcaaatatttacaaaggttgatcattttctaaaagttcttgatttgtatataaactgagttttcgtgattgtttttataatttttgtaagccatctgatctcgatgaatcttcagtattcaatttcagtcggtctcctaaccatccatgacaaattcagtgataatatagtaaatagataacaagtgagacgtacgaggttacttggctatttctacaaaaccaatatttatgtcggccatagttctatattaaatattgtcaccatacttaataaacttccattgcgccccaaaagtttgtcttttatca

SEQ ID NO: 305 - DNA, 3000 bp, Arabidopsis thaliana
aatgcttattatttcatgcatttggttcataaaaaaccaacatcaagtaatatgacaaaattacaaaaacaatttatgtttcgaattacttcaaaacgttcacattaatagtattattacaatacttagtttgtatcttgccattgttgatgaattgactctatgattttgatggagaaaaatattaggattttagtttatggataaactttttttgaaaaaaaacacaacccgaatctcaaaaatagttttgtcaaaaatcttgagaaaaacgatgagattcgggttcagattttttcaaaaatagttttattcgtgaaagatttaaattcgagcggagattgttccgcccactttaaaaaatattttattttctctaaataattttaaaataaaataattataataaaaatgaaaatttgaaatttttagacaccataaactaatatgttaataaaattattttatccaaaattagaaaattaatgtcatataatctaaaaaattaatagttaattgagatgataagggtaaaattaaaattttatttttgttgtcagatcgtgagtatgaaaataacaatatttaattgtttgaatatttaaattgcacagttttattatttcatgtatttttcatgtatttttcttcttagaaaaaacaattgggtattaaacgtttaaataaaaattagttaaggtttttttttggatttttacccattagaaaactcttccttttcatttatttttacttctagtagtagaggtaatttttcttttttgattaacaaagtcgtgaggtttgttagtagagactagaaagttgttgaatgggtaattgatatgttttgctccacaagaaagcggaagtttttaaaaaaaaagaaacaaaattagcattacaataccaatgattacatatgtaaacaatatttcccggaattagctcgtatgaatctaaattaatattgacaaaaaaaaaaataccaatgatcacatatatgacaaaaagaaagaatgaaggagaactctatcatggtttgatgctcattctatacgctggcccaacggtgacacgaaagtagacaattcttttaaataagttatcaaattataaagaagtagaaatcatcaacataccatttaccaagtgaggagagggcaaaatttccaaatttggaagtgaattgtattaaactcgacgcaaatcttcttaaaagtcttcttcttttgggttgcttggatataatgattattgcttgatgtcaaaattcgcacaccattgggatgatgggacccaaaaagaatcactacccacttctgccgttgtttcaacatcattcatgtataataatcacagtttatcaagcacacaaaatatcttacatgagtaacaacaatatgatattaaaattaatttggcacataatttaatcatttggtgttccgaccgacatgatactatactataattttattcccatttcatttcttatttttttatatgcatagaaaattatttaaatgcaaaataaaattttaaccaaaaacctctagtctagtagtttgttcgattgtatatagagtattttgtcatgtgcatagattaccaccatctacgaacattgttgtggtttgattttctctttgatcgcggtaaacaccaacaatatatgactagacattcataaacttcagatgagttaggatttgattttttagaattttggttttgaaaaaaaattagccaactaaaaatcaaacaaaaatttactgcggttcataagtaaaaaaaaaatcaatttcctttttagtaattttcttggagtcgaattgaagtaaaattgtgcagtttacaacacagaattcgatatttaaaaaatttctgttggcgaattaaaattgaaatactataattatccaaactttcttcggttagttaattaagatcagaaataatgtctaaatggcaaggttaatatggatatttgtatcagatctaatcccatttttaaagaaaacaaacaaggcaaaggacacaatcagcgactaaagctctcacacgttacagcttcttattggttaaaaatgaacgtggttgtcagctaaattaagtgactatgtttaataatcattaaaacgggatatttattagtttattaccaaaaaatgaaagcaaaatatctaaacaataaataaaataaaaaaccataagaggaaaaagcttaaccccttaaaatggcagttcgtgtcgaagctactacaaacacacttgtcgtctcttctctctctcgcagctcttctctattttcagcaatcgcctataatattaggtaaagcttccttctttttgtttatccgttttcgttttcttttcttctcgaatctgtctttgtcttatcacatcccctgaagtgttatactttttttttttttgggtccgattcataatatctgttttgtcttttttttggttctatgttctaaatcaagtagtagtagtaatgaagtaactattcctaaagaaattaaaggataagacttttttgtttttcttcttgagggtttgtgtgatcttgcttttactccagaatcttttatagatctatcttttagatacattcaagaatggtcaaagttatggattttgatccaatcttatatttctctctgaatccaaggatccaatttatactctctgtatcacacacttctatgtatatgtttgtgattgattgcttctggctaaaactttataaagttttgacatttatatgaacgttcctgccttttgcttttggtcttctttgcttgctcttatgcaagtatacttaaaagcactatgtgacacatagttgtgtggtgtgttatactcctaaaccagtttcaattttctggtcttgttctctcttaggtaaagctaaaagggtctgattcgtttgttttttcactgaagaatttggaaggaagtgattccgttgtgaaacagaaaagaagt

SEQ ID NO: 306 - DNA, 3000 bp, Arabidopsis thaliana
gacggttttatggatatatatggttaagacgtatcagccgtgaaaacttcaatatatacagaactagtgatcatcctatgttatgtttctccttatgataacttctatagtagacttcactgtcttcttctttacaaagatttatacaaaaaaagtactttattataaataccctttagattaatctaacgtatctttttcatccattgtaatgaagaagtcatgagataaaatgaataagcgatagatagatgtaaattattaaagaagaaaacaaaaggagattcttgaataatgttgaaattggatcgaaagcagtctgaaagagagatgcctcatcgattattattctcttttagccttaaagggacccaattcaatcgaatgtgcttgtgttgcacagatccaaatgcgcaaaaaagaacatctaaacttcaattaaaatattttaaaatccgtaaatccattgtcgaacaaacgtgacatcattcatgtgtcacttggagacaatataattcaatgaaagttttacaagttattagggcaggtaattcaattaccatgtaatgtcgatcataataatgtttttttcgcttacaactagattcatcttagagctgttttaaaaaattacatgataactttttttttctttcgaaaacttacatatacgatcttgcatccaaaatcttgctctctgtgcagtgatcgtagtagtccgatagaaattgaggaaatcaaatgagagatagtgaaaagataactctttactaaacgtcgtcgtttagcttcgcgcctttaaatgggccttgggtcaacaactcaaaagtgtcaaatttgggccagtatactgcagacttcgccgttttgaacattttctatacgggcctataaagtatagactatcctccttaatagatcatgcccaagttttatcccattacaaaagttttagagtccatccacgttacaaaggtgaacaaaaaatcatacatattatatacatgcatttgatcacacttacccttttactactttttattttgttggatactaagtatgtagatataatataacaaacttaattatttccaaaacattttccgactcagacatcatagcttttagttttcaaaagttcatctatcattctatttttaaagtaaagtacatattctttttcacaatcaaataatatgaacattgaaccttaacattcataaaatgattatcggctttcaattcattatgtcaatcttagtcatggaacatctattatcttacttttcgatcgtaactgcacacaacaaaaagtaacacgcaactatcggaatattggaaaataagtagggatacataattgcaaattatgaaacaaatgttataaaataaacaaaagaaaacacgatcgaaaagacttaacgggataagagaaaaagatatggtccagccttatctcttacctggaaattgccacgtgtcagacacaaccagaacatagcctctcttgctaccacaaacatttcttcaaatctttttgattacttttccattaatttaaagaacacacattgatgcttttgttatgttggatacgctactacaaaaccctacaccagaaaatatgttcatattaaatccacgtgtcggataatcattggtcacatgcttgacgaacagctagattctggcagacgaacctttttaagagttgtgagttgtgatggaccaatccacacgtggtgtattacagctgacgtgggcttagatgtaggatgtttcggagactgtgtgggtcatgtgccacgtgtttacacagcttggcattgatagttttatgccttgtcggatttacatgtaataatcatgtcagatatgtatttgtacctaattctgtctagaggagatagaattttcagatgttaatttgcaattgtattaacatcagttctgattggcaaccctatactgttgtggtaggggatttatcgttctattacccacaacaaaagtgttatcaaaacgttattctcagtttttttcgcattgctttctattacaattattttgtaccgttttgaataattttagtattaattaacgttttctttacccgctaattctttttgtatcattttgtattactaatcggatccaacatttttcagaaaactgataactgagcaatctcgaatcaaaacccatacttgatttcaaaaagctaggaataaccaaactattttttttttttttttggagcaacatgaataaccaaacatttttatgttttcggccacaaaggaatcgcagtgaaaaaaaatctaaactatagttagagaattcaaacaccaatccgtgataactattgaacaaccaaactactttactaattacttttagcaaatttgttaataattaatgtagacttatacatacgtcaacggatttgtaaaaccgggtttagaaaaaacatgaacttgagatgaattcgggtcatagtttaaaacctttttttcttcgaaatgtgttttaatttgtttattagtatgactttcatgttacgtagatctgactttttatcatctgtttttaggtttatctttttcaatacgtttacaccattttgaataagaaccaagtgtttcttctattattccttttaaaatccgacgtggcaaaaccaaggggaggtgagaaaatctttaaaacgccactagaaaggggaatcaaaaagagcgtgaaaaagatctcaaaatgcccactttcttcacaaacatgtggctctcctatttctacatgtctctctctctattctgacgtgtaattttctctcttcctctctcccttctaatgcactatctatcgtcattaataccaacctcaagccccttgttttctcttcatgctctttttttcttccctccgatcttcatagagaaaaaaaaaccagaggaaaccatttattagaccttcatatctctagaactttcataattagtt

SEQ ID NO: 307 - DNA, 3000 bp, Arabidopsis thaliana
ttctatcgtagtttttttttcggatgtgtatcttagaaagttttgaccatcccaaggaagtagaattaagaatctgatcaaaatattcgtttacttagggatttgtaaacgccttggagatatgttccgtcggtgaattatgaaatatatttgttgtggtgttattttcgaatattttttgggagatattgtaaccgacacctgatttctcccgtgactcgaagaggatactaagaccatcttcattggtagtcttttaggagattttcattactaaaataataaaaataaaaaaaaaaagaagagagagagcgtagaaagtttttcaagtgagaaactatgagatactctctacaagctatctttacatttttctcctttcaattggtttaattttttattaaaataaaaatttaatcatataataaaaatttaataaaatactaatattttttttgtttgagaaactttttgagtttcttcttaatggagatgccctaactcaacaagtgaccaaataagttaatttatttatgtgtatggttaagcactccaacgtcaacttaacatgaaaatattccttagcctaactcaacatatatttcaatttagagactatttggctctctgtaacaaccataatccagataattaatagaatatcttgacatgagatgtgtatctatgcacatgagatatgtatctatgcatgtcgatggaaacaaaaacagtttgtcctcatgcataggttccaagagatgtgtcggccgacaaactaaatacgctcgttagtaaatacataaattatacgatacgaaattattaggggtataatttccaaccataaatgagagtcgttaattgatgtgaaaacaatcttgtaggagtagtaatttagggaacaaaacagaacctccacgttacgtaattagacactaaaataaaactctcccaagaatagcgtaaaagtttttaaaatatatacagaatcgaaagcaatcaaatcatatttttcttatcgttctaaaacaattaatcacgaagagcttcttttcggcattataaaaccgaacatgtacaatttcctcatatccattagttgtttgattggtggtttttttttttttttctcgccaattggtggctttatgatcgctgtataactattgtcaacagagcccattactaacgtaacgtgcatgttcttcggtcaacacttccaatatctcaaatcaaagccataaccgtgattaaataactattttatgagttttttataggtaaaattgagtgatatactatatagtaagaaatttcagaagctcactacattttagtatcttgtttttggtcgtactaattgagaaaaatcgttttattttcataatattttccaattcatcgtgaatgtaagcaaaaaggttgaaagaaacgaataacaattattttaaaagattagaaaaaagtgaaaagagagttttgtagtacaagaaatgaaggaagtacaaacagagaaacgaatgaatgggtgtcagtattctcccaatcaaattgacatctactttccgtaccatacagctgtttccccctcttctcaaacctttttccccacttctatgtacaagtacatacatactattagttagattcacacactaaatctcgtgtattgtacttccttagaaaaaaaagtgcacacagagtaagaagagagggtttaagttttttttatacacatccggaaaataaagaaaggagaaattgaatagctacataaatcaatccgtacaatgcgagagatttcatatagtagttttgtaaaataaaagggtacttatgtctttttgtatcgacaggttttttgtattttatgatgccgacttcctccaaacgtggacgcgctttatggttagtgtgtttaagtaggctaaaaatctctaaagtgaaactcaattgtcaacgattaaagaattaagaagatgtaaaaaaaaaactaattttccaaattaattaataagctcataatatagcgtgattcgcgttaccgaatgtaatttgacttgtggtatactaattgtgactttgtttttatttctttgacattacgtaaaatttgtttctaccaattttgataagtgcacggtcaaatcaaaagaggaaaatgaaaacttggggttgaattctcaacttgaacatatatgatagtcaacacgacaatacgttgtattccttatattgaaatgaagctaattaaggtctatatggaaacaaatatgttatttatttatcaatgacgtatcacattttgacgaataaagagattaatgttatcctttacaaaataatgaaataagaaagaaacagaagtttatgtttgtccaattatcctcaatgtttgttgatatacgaattttgagaattcaaactgaatacaagaaataaaaatgtagtgagataataatacaaatttgcattatttcttccaagattgttttctttaagtaaatgaaaagtatcttggattattacagaaatgaccctaaatctttttgaatttacagtttgtaccaccaccgaataaaataagaaaaagtttcgttaaatgttacgagtgctcgttgaagacgaagtttcgaagacgaccaacaaagagaaagatcaaaatttgagagggaaacaaaaaaagaggaagagagaagaagaagaagaaaacacccttgattaataaagtctcagactttttgattcgattcgaaaaaagtgagtttatgcttgaagctgggaattccaaaactcggaattcgtgtaaaactagttcgatttatcagagttatgctaaggtaacatagtcgattcatttcaaatttacgaactttatgttcatctgatctctctctctttctcttctatttttggtaacgaatctcgaaatttcttgtgttgaattttgtagttagtgaaggtgaatgaaaaagagttgatttttgagagaggagagaa

SEQ ID NO: 308 - DNA, 3000 bp, Arabidopsis thaliana
cccaacatgcatagtgtttgacacaacaatatatgacagctaacttttaagtataattcgaaatgaactaaatcgttgattatacataagtttaggttatgagtttttgtcttttgcaatctattaattaacaattggtttgtgaccaaattgttcgttgagtgttgtaagaaccaacctatttcaatcagtttcttaaaaaaggaaagggaaggcaaaaaaaaaaagaactattagcagccttacttttctatgataatattagtcagtagggaaatatatatatatatatatatatatatatatatatatatatatatatataatttggaccgacgactgattacaataactgttaaagcttaaaccggcggaacttaatcttatataattaatatgattgtaattagctgtatgataattttatgttgttaatgatgatgtattaccttttcgctatagggtttatagattacatctatacttctgcatacaattagatattaataaagttataaaaacaaattaaactgaataattgtgtgtgtgttacgttgcatgtgttattagttatggagaaatatgatttacgtcttctgaaatgctatcaacgattggtttcagatttaaagaaactatctgaccaaaatcctgagatatcttaattagatatatctatttaaactttcaagttgttatatgttaaacagtaaatggcgttttccgtattactcatctagtagatcgtagtaagttatatacgtttttacaatgaaaggtttcggcaatgtaagttgtatacgtggtacgagtgagtatccatacttctaccggaaagaatagagatcaagaaaaatgaatataattaataaagctctaccgaggaaaagaagagtgaaggataatggagaaaaataagaaaaaagatgatgagatctgaattaagattttattattcacaattacaagaataggtacagtcctggtttgtgctaaaccaaattcgaatatcaaatataaattacttataggttcgactgtaaaatgagatatgaaagaaagaaataatatatgatgatgtaatgcatgagaaagtccaaaatgatcggcatatgggattaagcgattccatatagttaagtcaagttactatttcagataaatggataagtttgtcgtctatatgttctgttatctccaaacccaaatctataacattgcgacatttttgaatcgttaacggcaaaataagtggggaggggggggggaaggaaaaaaggaaggacactgagattttgataaagttcggtagccaaatttgtgcatgacttttaagaaaatacgtatgctgatccaaaaacaaacaactaaatagattttagtttgagaaaatcgaagtaacaaaattattatttaatatatagtgtgagaatttaacagctactaataattatcataacacgaattaagtgtaatagtaatatatgtaggaaaatggtttagcaccactcacttgattaactcgacttaaaccaaatataaagtaatatttatagatgtagttggttgtatttttgcaagctttggtactcgatatctaaatttttaatggaaaaattagtcgagtggtaattcgttatatataagaaaatattttgtttgtaattgtgcaaactttagcattggacatctaactatattctgaaaaatcagcggaatgataaaagttcggattttccttctttttatttaagtaaacataattggtgttctgaaaaccaaaagaaggaagaaggcaattaagatttgttaaagttcgtcacgatattgatgtcaagaaaaaaggaaaaaaaaaaaaaatcgtcacgatggtatcgtcaatttgtctagtggattttgaaaagccgtgtgggcttgactttgaccgaacaaggcacacgtatacatctagtactactgaagaaatctctcattagaacgcaaaccacgttccgcacactcttaatatactattagtctattactatcaccaactagttgtcattttttttgtcaaacgtgctaattaattcacaaatagaagtattaaacttcctaattaagcacgcctttactacatttcattattattatacatgtaatcaaccatttcttttatcccacatgtcatttgtagtcctgattttatgactttatgcatcaagttatctttttttttgtcactccatgcatcaagttatctaaacaacataattattgtctgaaaaatctaagatgatatacaacatatgtatttaattacacattaggcttgtttaacaattcttgattatttttactctttttgggtgagttcttgatggatgtcttgaattacaaaactacatattctgaaaatattaaccttgagtttaggccggctatgctataacgaaaaataaataaaagcaactaacccgacagaaatgtcaaccaactatccaaaatgaaaaacaaacgtggagagcgtcatattattagtaggccaatcacacaccaaatgtttgtttaacaaaaaaaataagaatgtcaaccaactatccaaaattaaaatcaagaatacatttcatatgtttccaatatgtttttcttaaacaaaattgggactaaagattggaccaaatacgtgtgcgggtggacccgatagaagccgagttgagtctaaagactaaaaagtaaacaaaaaatgataagaccatcacttagtttattgcatgaaaatgaaaagcacatgctcctctctctctcttctgcctctttccatctagtttcctcttaaaactccattatatatagaaacaaaatcttttctctcttcaacaatcccaccattaaaaaagaagaacccaagatcgactcttacttcgaatctctctcaactttcttcctcagcttacgggaacttccacacatatacatccacaagaacccatatcgaagattcatcctacatatatttac

SEQ ID NO: 309 - DNA, 3000 bp, Arabidopsis thaliana
cgaatgcagacaatcaagaagttgacaacgagtggataatggacacagggtgctcatttcatatgacaccaagaagggactggtttgttgagtttgatgagtcacaaaccggaagagtgaagatggcaaatcaaacatattctgagatcaaaggcattggaagcataaggattcagaatgatgataatacaaccgttcttctcaagaatgtgagatatgtcccaagtatgtccaagaacttgatctcgatgggaacattagaagatcaaggttgctggttccagtctaaggctgggacattaaaggttgtcaaaggctgcatgacactacttaaaggaaagaaagttggtactttgtacctcttgcaaggagttgttgtaacaggaaatgcaaacgcagttacaagctcaaaagatgaatcaaagatatggcacagcagattatgccatatgagtcagagaaatattgatgtgttgatcaagaaaggatgccttcaagctgaaaagataaatggtctcgagttttgtgaagactgtgtgtacgggaaaacacatagagttggttttgggtctgcaaaacatgtcacaagagagaaacttgagtacattcactcggatctttggggagcgccatcagtaccaaactcactaggtaattgtcagtactttatcacgtttattgatgaccttacaagaaaagtatggatttattttctgaagaagaaagaacatttcttctcttgtatgttgatgatatgttgatcatatcaaagaacaaggaaacagtcaaggaattaaaggaaagactgagttcagagtttgaaatgaaggatttggggcctgcaaggaaaattctgggaatggagataacaagaaaccgagaagaaaatattttggagttatctcagagaagttatctgcaaaaggtgttaaagacattcagaatggatgaatgcaagcctgttaaaacaccattggcaccacatatgaagtttgtagcagcaacagagactgaagcagaggagcaagctgatcaaatgaagtctataccttatgcaaatgcagtgggaagcataatgtattctatgatcgggtcaaggcctgaccttgctcatcctgttggagtcataagtaggtttatgagtaaaccattgatgaatcattggctaggtgtgaaatgggttctccgttacattaaggggtctattgattcaaggctgcagtacaagagagaaggtgattttgtggtgacagggtactgtgattcagatcactctggagatcgtgatcgaagtagatcgaccacagggtacacattcactgtaggagggaacatagtaagctggaggtcatgcttgcagccagttgttgcactgtcatcaacagaggctgagtatatagccttaacagaggctgcaaaagaagcatattggctaaaagacttgatgaatgagctgggatttaaacaaggagcggtagatatccattgtgattctcagagtgctatagctttagcaaagaatgcagttcatcatgaaaggacaaagcatatccagagaaggtttcattacatcagagatgcaatcactgatggagaagtgaaagtgctgaaaatatccacagttcataatccatcggatattttcacaaaggtggtaccggttaacaagttcctgagcgcgttgaagaagctcagggttacaagtgcctgataagggatcatggtccgagatggaaatcaagttacactagaagggaagcaaaggaaaggttgacactaaggcaaggtgaagttttgtggaagtattgcctaaagtgtcataaagactctaatccaaagagaaggtctcagcttgtgaaagaaacgaagtcacgagaggcgcacgtgctttgtcatacagctcatcaaggctagagacgtaattaacctcttgccaatggttcaaccattttgtctctttgtctctgcatttgaaacagagtacggaagaagagagaggagcgtggcggtgagtagagttgtataaaggagaagataagtgagacattagggttaagagagtaagtgcaagagaggcagctgaaagtttattcagtcttgtttctaagggtttgtgtaaccaaggctttctagtggatttccgggtaatctcggtccagacgtagcgttcatcactgaacgtgaactgggttaacatttgcttgtgtctgttttactttctttgtctaaacacacgagtgatcgaacaaagagagatttagtgagagcttccgcataaaacagttaaagattcaagctttttttttttacatcaacatttactaataaaaatgtatagttgaattttcaatattatatgctccaattgatacttcagaatgtgttaagattttcagcttagcaaaagtacacaaaaactatagtagaatagttcaaaaaaaattacaataacaattaatgataaattttgagaccatttttgacactgcaatttccttttaaaataattaataacaaattaacaatcaaaatggtgtatacactcacctaccattcaaacccataatttcatatagaacatattcctaaaaatgtgaaaaaattttaaaagattaaaaaatatttgacaaagagtcaaatacaaaaaaaaaaaaaaaaaatcctatctatgtttaattttggccatcagaagggaaatcaaataaaggggagatagagcgagtatacatatacaagctactcgcagcgtctgcaaattcatctatccatcatatttctctgctgctctctgctttcttcttcttcttcttcttcttcttcttcttcttcttcttcttcttagtttgattcaaaaaatctccttcctcttcttactttatctcgtattatccattaatcctaaaccctttagtctctccatcttccgcttcaacaatcagaatttgggtttggcgaaagatgctaactttgaaagtgagactaatcgtttgagtaaaaaac

SEQ ID NO: 310 - DNA, 3000 bp, Arabidopsis thaliana
ttctcttagaaggggaaaaaatacattgttacaaatttgtagtatataaaggttaataaatacaccaaaatgttaaaatactagataaccaacaacaacaaaatcttgaaccttgtgtaaatgtgtgcttggttttatttgcaagagtaaataaatttaaagtatcttacttattgcaaactatttaaattttcataagaattggtgacgtgagcgactgctcaaagatcaacaaaatgttttaactctttgttttttctaatccattaatcttcctacaaaatccaagaatctgagatgtgaaagtggctataatcagaaaaatgtttttgagtaaaaatcagtatatcaccaataaatagaacaacttgttgaacaattgaaataagatgcctttgtagtgtctttatagacttgtttatatatatcctctccaacaacgtagactctggtcctattttcatcatccacgtcaatatcagaacacactgccactttattctcctcatccaacaagaaacttgccacattcaccacgctcggtaaattaaacttatcataatccactgttaagacgaagttgctccacgacaattctatggtttcatcaatcttattggtcaaccatatcttcatctcatttgaaaattcaagaatcttttgatgtaacactgagagtttttcttccctaacaactgatagagaagcagtatcttcacgattaaaactcttaaacggaagaggaaaatgcccaaatctctcccttgtgaaatcaaaatacaacatgaacatgcccatttctttatctccagcaacccagtaagtgtttcttttcaagggcccgccacttgaaaatacaccatagtcatgagtgaagtaatcaagaaccctccaagtatcagagccaaactcatagatctcaaactcagcaacccattgtttctggtcgtttctataatagcaagacctcaagattttgaagctatggccagaagacttgctgtttacgtatcctaaaccatagtaatcatcattccgaaaacgagttctcggtttgatccaccgggtttcaccggtactggagtcccaaaccacaagtctagtgtttcccttagtagagcataatattaaaccctcacagtgggaagatcttagatattttcaaatcctctgaatcctttagacggcaaagtttaccagaaaactcgatagatggatcaacgtttttgtgaattccatggtgatcgacactaactgaataaactccaaaattactcagtaacatcaacttacttggtgcgttaccaaagttcttcttgatgaagtttggatctctgaataaagcataccatcgtttgcaattttgctagagacttggttggaaccctagagagtatttcagattccaaatcgtccggaagatcggagatcatcattgtctttctcgttgttgctgatctgatcacttgtggaagaaagcgtacagtatatttaagtgtatatagaaattagggttttcgttacaataagcccataccatttattgaaaaccttattatgtgttgttaaaaagcccattacctccactgatcttcttttatgtttttagcatatatactagaaacttgggtctcaagctcttgggttgtacggttgtaccctctttttcttttggatttgagttgttacaatttttcctatcatcatcactcctcaacaagttagatgcaaatgattcttagctattttcttttagagtgttcatcaaacatttcttcatcttttacaaatagaaagttttcttcaaaggtattgaatagtttagtacgtcatttcctttataattttttcatcctctttccttaggtcttgttcacctagtaccaaaccctttttggcttcttcataaaaatgatggcattgcaaaactcaatttgtatttgctagattcggattttcgcagaacttaccctcgggattttaaaggtagaagtgttgtgatttagccgtatttattagtaatacatacaatatttttatttttatttttttggttaaaaagctagtacattattatcaccaaaaccgtttaatattgtagtctacggacagcttccaaactgctgaatggatgacgcaattcattgcagttcagacacacgaagtctcccttgacctgaaacaacaaccatgtaaatgaaagtgatgagacagactaagcagaatgcacaaacctgtagaccgaggtactttagaaaccctttaggatctttcaagtactttggcaatcataatgtctaaatggctttaccatggaattcattatgtatagtattaaaaaaatcattatatcaataaatagaaacaactacttatgactaagctcgaacaaaggaacatcaataaaaccagaagataaagaaaaatcatgaaaatcctgatgtaaaactaagagtttttctttcccaacaactgatagagctgcaatatcttcacgattaaaactcttaaacgaaagaggaaaacgtggttctatcagttgttggaaaagacaaactgtcgctgttacatcagaagatattaaagctatggccagaagattttaaaccctagagttccgattctaaatcgtccggaagatcggagatcatcattgtctttctcatctcatccctcgaggaagaaagcgttgcgtatatgtgtataaaaattagggttttcgttacaataagcctaatcgatttatctaaaagcccattagaaagcccattagcttcacaaaatgtattttaacccgatttaaaatttcgtttgggccaaagccatcttaacccgacccatattaacatcactgcttacgcaaacacaacaagatttggagatttgtcgttaaacaaatttcgccgacctacgtatgagccgtcgcctccaatataaaccaaagccatccctaatcctcgaattcttcctctctgagtttttattctgagatagagaaag

SEQ ID NO: 311 - DNA, 3000 bp, Arabidopsis thaliana
tctttaaagacttataataagaacgtttcgtaatgtttttggtcatgtgttaggatcttgtttcagaatccgaccgttgtgtggttggaggtgttcagaactcactgcaatcggctcttgacttgatggcatatcttttaggtatcattgtctccaatccaaaggtaaataaattccagtttatattctaaggatccatatatagataatgactctttttatccatcaaatgcaaaatttacgttttcatacaatcaaggtcataatatttatggacttttttatttcaggatttttggatattgacgttgatctcattctccacagtatcgttggcaggaatgctctatacaattcacctctaccgcataagaaaccatatttttcatcttgagaagattcctttgttgaacaaatgtatattcaagttgctcccttctcgtggaaacgtgtaattcataatgttgtggaatgtgccacgatttctccgacatggataactagaaatggggtggttttatgacatgaccataaagcagccaaaaatgaatcaaatggcttaaatgattggttaaataggtcaaagatatagtcaaaagaaaacacccacaaaataggtcagtgacaattttgtgatgtgttaaagacaactttcagtgacaattttgtgatgtgttaaagacaactttcctccgttttttgtatgaattcactctgttttgtatgaactcacttttatgtagttctataataacaatgaaaattttccattttatcttttgggaatagaattctgtattaaaaatcaatactgaaataacattcatcattagtagtagaaacagttgaaaactcccagatatttgtgtttgcttaataaagtacacactccattattatatgttaataaagaaacattaagaagattgatgaagtctcttcttggcattctctgcttcatcggttgcgtcaacttgcatttttgtctccgttagatgagcctccgtagcttccttctcgttctttgccgtcaatctctttgtcttccaaaccaaaataaaaataaaagattataacaaaatgaaactaatcaataaggaaattaacgagacaccaaatacgtcaagtgatcattgattcaagaagacccatgagtctctgatccgcttgtttcagtggctcgaaacaagactcttgtatacgcacctggccaacaaaaaaggctttgacatagctaaacccttcctggcatgttactgccatggataaacagttagtcttcactcgatcggacaaagacttcgccggctgtcgtgatgtctcggcgtcttgcatcgctgctttttcgagatagatagattgcttgaaacttgaaagcaagactaggaaatatctcactttcttgtgccaatgatgattttttttaactattaatgattctggaagcaactcttgccacgtctgttttacgtgttagctgtagagataccgacgtgtattaaagcaagaggctattttactttgggccttttgggcttttgggctgaagaaagaaactgtcatcggatcaacaaacactgcatagtttgcaacttgcacggtaaagcgacacaaaatccatgacgtttaatttaggttccacgtgaagaaccataccacatatcgtgcaataagaaactgatcacttttatatacctaaacgatttacaatttacactactatgcttgacacgatatgtaatttttttttttttgccaaagggtgttgttattgatattaaacattgtacaatacaacgtacatagactgtttatataaaacaaggacgtctagataaaaaaagcaaataacaaatattacaagactagttaaggaaacaacaaactgagtaaggttttatgtacaaaacagagacgactaccaaagaagagggccagacgtggtagcagtgatggaagacaaacatcctgacatctcaataagaacatttatggctacttcaaatacatatatacacaatatgtaattctcttattacatttatggctacttcaaatacatatatacaaaaaaaaaaggcctaccttcgacagaagttataccaatttattgatcggaagctacaaaatgttatctagggtcaatttgtagcctatctctatatcaaaaccgatacggatacaaaatagtttgataatcatagaatttaacattctaataaatatttgtttctagtattctttaaatgaataatcttgtgttcaattagtctattcatagtagaattaagtctcctaaaaaatagattgaaaccaaaaacagccgcacatggatttaatatcgactttagttaggaggttttgctaaaaatagtaaaatactcacaaactcacttctaaatactaatcttttacactcatgtcatgtgctttaaagatatgagagaacctttcctagtacacctacagtcaaaattttcaagattccgaaattttctaggttttttgagcaagagccaagaatcccaaatgtttgaatttgtatttttgatccaaaaatactacaacatcgtataaagaataaatcatacgtgtcagaacgagacatatgaagatgatgaaagcattgagccgcccctcaaaaaatccgttcaacgtttgagagtcaaggccacaaggtctgaccaatctatctcttctccttcttcttctaatcatattttcaacggtcaaactttttatcaccttctcagaaactactcttcttcatatgtgaccctaaaaataaaaacgaacaattaaacaaaattttaaaataatataatattcaccaatcagacgtgcaatatgttttatatattcagacataaccaacaaatatacagaaacaagaagaagaacaagaaccatcacttctctcattttcttcttctccaagcccccctcctttctatatatatctgaaattggtcttttataaaacaaacttccatttttcgt

SEQ ID NO: 312 - DNA, 3000 bp, Arabidopsis thaliana
tatcagttcttaagttaaaaatgcgaataccatgtattcagttttcgcgaatgaccgattaactgtcttccgatccgtttttttcgttttccatgatatcgataactcggtccacaatctgatgcaatttgctgatgagttttgggaaatattttggaggcaaaacacacaaaattatttcactataaaaatgttactataataataagttgaccatataaacaaagaaccaaaattgaccccaaggagcgtcgcatagtcttattcttcagcaaatctacgactcgacttacccagaaacatgatgacacttttcttttggtaaacatgatgtcacgaaaaaaaattacacacataatctatagatagttagaggatgtgttagaattcacatatcagtttaattggtagtatatgatttatatgctgattatgattgaaaactatcagcctgttttaaggtaattatgagttatgatgggtacttatgagtttgaccatatataggattaggttgttaaaatgcatacatacaggttatgtgtatgtttatgtttatattttcatataaacaacaacaagtacactttcttgtaatttagtgatttagatttcttaatcaatttgtgtttttttttaattgtggagtagtatgaattgagttcacaaaatagcaaatttgtgactacgaaaactccacggaagatatatagaagaatcgaagaaaagtagagaataatgaggagtaagtcaaatgatcaaatccacggactaatccattatgtttgatgtgacgagagaaaaataagtgaatatttaatactatatactatagtatatttttgcaaaagttaaaggtgttgcattaattttttgatagcaaacaattaaggaaatgggggaaaaagtgtaagcgggcggccaagtgaagacattctctgtcgcccacccaaacaccaaagaagagaaggcgtgcctcactttccctctttctccacgcacttctccttgcccgtgtttctcactcgctttaccctaatcactccattacaactatacctacaagaccattaagataagcttatcaataagaacactgagataaagttgatctctatttacgaattgtttactaccaatagattttgattcgtaccaatcttttaaagtatgtatgtattgtttgaatagtagttctaccgaaccaaaaatattttaattgatcatgtaaaatatatttaagattgttgtgtgttaattatagtgatctttagaaaaaagagtagccaacgtgataatgaaagcgcgtgttaagagtattgaaacactcacacgcttgtggaggttacctgctaagtcggtcgatttgatcgatggtgggtcttttacacatccccaacgtcatttaccatttattcaacctcatatattatgttcttgatgatgaaaaagaacataatatttttttttttttttttttttaatttttttttgatgatgatgaaaaaaaaaaatattatgttcttttttaatttctttttaatatttttgacagtaattttattttaatcttattttgttacaaatagtttttaataccttaggacctgttggaacttggaaaaaaacaatattttttaatatctcaggatctttgcccatacatgttttgggcacccatgcgtttatatgaaaaacagcatgcagatgtaaaatataaacaactgtagatttggtcagatgttaaaatttaaattatgtcttttgaaatgtgacctataattgtccagatagatatacataactatttagtaattgtaagtctatttcctgtaatgtattcagctaaatgcatgtagataatctgatatcacatacatctatagccatatagagaatgcatagtaacatcaacaacatataaattttgggctattttctaatgagggtttttgagtataaatggatctcctaaaacgagtttaccggatgggtaaggtagtagttccctttgagttttctttctgctttgtataattaaaacaaagtaattgattaggaacttagtaggtcctaaagagaaccaacaatggtttcggttataaataaaccaaatgggtacattatccttatatctagaaactttaaccaaaaacaagatgttatctagaaacaataaatacatccggaatgagactttttcttatgtaagtcgatacaatgggggcattgttttatttcccttcaaatgaactttgctttttgatcattttaaaaagccatattgaaaaaatcaatgagataggaagatagatattataatattctttttataaaaaagacaaaaaaaatacactaaaacaattgaataagagtcagcaaaacaacgacgtccttaccttttttaaaagtttcccagttttgacttttgacctaaaccatttccatgtagaaagagagcaaaaaacaaaacaaaacaaagataagtaaaaaataaaaatgatataaagaaggaagaagaagaccgagaaaggtagacgaaagaaagagcgtaccttcctctttccttcttcgtaaaaaccaagttccttttaaaaggagcctctcctttctcatttgatccttcttcaaaaaccccaaccacttcttctccccaaaaacctccaaagtttcaatctttacttctctctttttctccaagttatcttcttttctaggtatgtcttgattctttctctctctgttttttcctatttcattcaggattctgggtttggttaaatctttaatctttatggttttaatggcttgattttgacgaaacggtcgtgtaattattcattactttgcttaaattggggattgattttgtgtataaagaagaatcttgaaaatgaaaaattgaaactttgaatcgaaagaactcaatttgcgttgctctttctcattctttgttgctttctcctaaaagtttttcacttttgaatcacaggaagagat

SEQ ID NO: 313 - DNA, 3000 bp, Arabidopsis thaliana
gaaaaaaaaaacacctaaagaagtgaatataataggcatatacatatgaggaaaatgaaaacaaaaggagcgaaaaatagatttaacctaaaagaggaagtaaagaggttataagaggtaagaaaagtaggaccatataatagctatattgtagaattttattatttggagatatggcaatttttgtgagggtcccatgaagactaaagtgtggagcacgatttatctttgtaattaataaaataataaatatattattattgtctcgggatttttcgattgatgagaaaaagtaagaggtgcgttttcgaattatcattggctaacgtttgtacgtgactgtacggacgacgttgatgtatttctaatattgtactcttttttcccacccttatttctctaattcttgtacattaaccccaaactaattttacaaacacattggtgtttaatcattgtgaaattttgatttatctaaaatacactttatatgttatgattttgcatgagcttatgactggtaaactcatgagatttccatatcaccatgttggaagttactaaccatacatcttttaaatgcaaattcacatcattcctagactgctagacagacatgtacttacttatacaaggtttttctaatctaatggcaacaaagaaacttgtgactaaacgcatacgtatctctcatatagtgtagactagaactctacgtatctctcatatagtcatatttttaaaaaaattatactttgggatctcgaagcgaaaattagattagtttatatgattatgtacaaaaaaaatcggatattactaccacttaaaaataattgtagtggtcaatcatatctaaaattaatcgcagtgaacaaaaacctgaagcatagcctggttctatcttactttcgatgtgacacattactaacacgattgttttaatctataggacgaatcctttaagtaatgtatagttggttcagttacgttagatactttttgttttggatttgtctcaaccagttaagaagtgatcgtatttactagtggtatacgatgatgtttctttaaatctgaattgggtctacaaaatacataactaaacttcaaaccgggtttatactttatacaaacacgaaaatataaagatagagacaattcaccagagaagatgtgtatttatataaaaattatccatacagattttcggacctatctgtttgatatttaatatatataaatacgttaacatatttcaccagagaagatgtgtatttttcgaaataattagtttgtgtggtcctcctcccgatatagataaaagatcattagatatcgattaacaattttatctccaaaaaaggatatttttttggtgccactagctagacaagacgttcgataagctgaattattattggatttctaagttacgttttctttagtaatccgagggaccaaaaatagcaaatgcctctttagacacgtcgctacttaacgccattgccccattgtctctgtactagcctccaaatatttggattaatggtcacttaggtaatgaggaaattgtagtattttgtaatgtggttttgtccaacttataaaaacttacaattgcaagtaattaattattcacatggagatgtaagattatgtcatataactaaaaacacaatttaagaacaacaataagaaacaatggacaaacaagcatagaaaatatacaaatcaaatgaattttatctgttgggatggaaagatattataaaaattgattaaaaccaatatagttgtattactcacaggtaagaaaaaacgatattcttatttttcatatcaattacaagtgggggcatataggtacgagagagtgtttgtgtccacattaaaaacaaaaaaagatttttgttagaagaaatttaataaaaataatttgacaggcatttccatccaactagatatttatgggagggaaaaagatgtgtatgtaaaaatgtccatatgtatcaaaatatgctatttttggtctttcttaaggcttttttccaaaataagtaaaggatgaggtttcaagcgtccatcatatttgcgacacatatgactgactatttagctcctccctctttctttctcttattttattatctttctccaagaaataaaatagaaaagaaaatatatatggtttcacaaacaccattaccataactacaacgagaagaggatcttttttaaggagaaaagcagagagagaagagacgagtgtgtgaagtttttttgtcttttgtttcttttattacacacaaatagatgaaacgaggaaagctacttcttttgctacttccataaaaaggttcttcctttcgcagagaatcaactttgatcatcttcttccttctctttctttcttcttctccctccagtaatgcttatatagtctcctcctatatctctacctatacatacacaaaccctttatcctcgaaagcttcctcctggttaggtttttatcaaacccttttagccaatcggtaagatctcttcgtcatgatcttttcttttttcttttgctttgtactctgatggatctataaacttatatgggtttggtttcatttggttcgatttgatgtgtttggtttctttgtcctaaatctcatgaaaggaggttgcatccttcaattaaaccgataacaaaagtttccattacagacttatagatcagatactttagattgttttgctttttgggtacttaatctttcgttgacttcatcagtcttctcccacccaaacaaaaaagtcatatttcgatcatatcttcatttttttaacctactctctttgattcatatatgaaatgggttgttttatgtgtgtgactaatcttgttattgaggtggttgcaccattgatctaccgttttcttcaatttttgaaaaaataattttattttttttctgtgtgcaagggaaattaactaaagaagaagat

SEQ ID NO: 314 - DNA, 3000 bp, Arabidopsis thaliana
caaatatttaattcaaagattttctttctaattatcaaaaacaattattaaatgccagtggcagccactgtaaataaatctcaactctaggatttatttcacaaagtggctgcaaaaatgtatatataaatatctaatctttacttagatggcatgggtttgaaaagttctgagtaactgataggcccaatgactaaaagcccatatgtgtttctcatcataatggaaggcctacaagtagaagaattcgctcgtgtttatgaattatgatcttgattgtaatcttattatcaaaaaccaaccgtaaaagtatatgaattgcgtatttgtaaattgtaattattatatagtattgagattgtgattaaaagtaataatgaatttgttgaattattattatagactatagtatagtagcaagagtgaaattttgttttcaagaattgagtcctaattttataaaaggagccaaaaaacccaattctatctaatccaatgaaaactccaagatcgtctctacgtccgccacgtcagcactatcctgatcgggaaacccaaaacgagtggtcgaatagtttccgactggtaacagagaaagcatctccacaatccccaaaattctttcaacacttgctctccattaatcttttagataataaacctaattgtttctgttttgtttttgtttctgtgagattcttccgaggcttgaagctcaatagctatggcttctctttcagtctcttcctcttcaaccatcatcgattcaagagctcctccttctcgactagcctccgcctccgcctcttctccgtcgtgcatttcacttcccacacttccgattcagtctcatacccgtgccgctaaagccactgcttactgttcgttttccataaatctgaagatttttcttttcacttttaatttcgagtttaaagtttcaaactttcgaaatgggttttggtttttaggtcggaagattgtgaggaacgttgtgacgagagctactactgaagttggtgaagctcctgccactactaccgaagctgagactactgagttacctgaaatcgtcaagactgctcaagaagctgtaaatactcttactttatttatacaatgatgattctacctcttgcttctgggttacatgtactgaatttggttgtttggattgaagtgggagaaagtggatgacaagtacgctattggttctcttgcctttgctggtgtagtggctctttggggttctgctggaatgatttcggtgagtagaagaatactactttcttcttaaaaccctagtgttaaatttcctttatttgattccaaaatttgttattgtgaaacaggcaatcgataggcttccattggttcctggtgttcttgaacttgtaggcatcggttacacaggagtgagtttcttcttctctttgtatcacttgaaccaaagctctcatgaacctgttttgaggatatagatgattcatcacttcacttttggatttaggattagttctctgaatttagaatccgaacatctgcaattcatatggagatatgatatcagaaattgattgctgcttctcgctagtgtttcaatcttaaaagacgtgtgtagtttgtttcaattgtgtgatggaccttattaacatttggtttttctatggcagtggttcacttacaagaacctggtcttcaaaccagacaggttaaccaattctctctttaactctgtgtttggttgcatgtaatactgagaatggaagactcaaattctcgaggaaattgtttgttatctgtttcagggaggctttgtttgagaaggtcaagagcacatacaaagacatattagggagcagctgaatcaaaggaggaagaagaagaagaagagcctttttgaggccattcatgaattggaatgaaggatatcaaaagaatctaacacaaaggccacgtccttccttcaatctttccttcttgtaactaaataattttcatcctttctctctctctgtctctggtcttttttagctcaaagtatcatccatttatgtcaaagtgttgtaaattcctcaagactatatatgagatgttttgtttcattttccaaaatttcaaactttgtccccatttagtcttctacccttcatgcatggttagcttagcttaatgctgaactgttgaataacgatatgggccttatgctaaaagaacaaaaccttatgggtctaaaaaaaataagcccaatataaaactatggcccaaataagtttaggtccattagagtgtgagaatagcgcgtgtagtgaaccgcacgagaatgcgcgttcgattgttggtgaagtagtcgtctagattcccgggtccactgatgtttctagtgtatcagacacgtgtcgacaaactggtgggagagattaacgatcttaagtaggtcccactagatcaagatattataacgaattgacctttttaacctttcaggtagtcccggaactcgtggcctagaatacaaagaaggttgtgaacaagttgatgttaagatggacaagaatgtaacttgaacaaaagctgaatcatctcttcagccactagtatgttgacatatggcagtttcttttgtagcctcgaaataaataaattaaaaagtttgaggttaaagataattatagtggctgagatttctccatttccgtagcttctggtctcttttctttgtttcattgatcaaaagcaaatcacttcttcttcttcttcttctcgatttcttactgttttcttatccaacgaaatctggaattaaaaatggaatctttatcgaatccaagctgattttgtttctttcattgaatcatctctctaaaggtacttaagattgatttattgtcatggtctttcttattgtttgatgaataacttgacttgattgttttttgttttgtggattagtggaattttgtaaagagaagatctgaagttgtgtagaggagcttagtg

SEQ ID NO: 315 - DNA, 3000 bp, Arabidopsis thaliana
acgagatcgacaacgacccggactgccgtgagatcgagaaggctcttctccggctcggctgttccacggcggttccagctgtctttgtcggaggcaagcttgttggctccaccaatgaagtcatgtcccttcaccttagtggctctcttgtcccattgatcaaaccctatcagtccatcctttactagcaaaattaaaccaactcaatatataatatctaattattagctagtgagaataaacacagttacagctagagtgtgagctagctagatattcagtgaggacttcgtctgaattaatgtttatcgtttgtatgttctattgtttagcttctctcgtgtttcagtttagttaatcaactggtgtatgttgatgtatgactctctgtttatgctaatgaaaatagtattgaaacttttacattttttcccacacaattagtaacgatctcttgtgtatgttgagtaatttagggctttccatataataaggcaagaaaccgtttatacttgtctgtttttaacatggtatcagaaggaggctacacacaaaccattttcttatttagaaatattcacatacactgacagtagctagaataaaaatgtgaatggccaacacatgcatgaactcgtcttctaattatcaagatgtaatgtataagttggcttcatcattattagttagacctattgatagttaacattatatcgggcgatatacagatttagcctttgtgatgttgtgtttagagcgtacttttgaatcaaggataaatcagtgcccattagagtatatataaatcgaatgtgaaaaatattagatcagaatagacttaattagtctccaccatacaaatttggtaagaagaaaaacaatgataagataccagtggcctaatgcaactaaagcagtttgaggaagaggatggaagatctttcgcggtccaagtatatcatggctacacaaaatcactgctctttttgcgttcctttattcttgagtatcttcacgtttaatttactattattttctaatgaaaaattgtacacctttttatatatatgaactctttgttttttcgttagttgctcgtgtagtaaattaaacatatatgctcataatcaataaaaacatacaatgttagaagaaaaaaatacaattttttttactaacgaatcatatgaatagttgttttatatacggtacattaacgatcctctcatcagctttatagataacgaagcatattattctccttagttccgctttttatcacttgagattaaactctactcacaggtttaagcacgtaaattagttactaaataatggatttgacatttacgctttgcatgcttatatatgttacccataattatttccctttagttacttaaagttaccaaaatcaactacttcaagattctccaatcaaaagaagcgtgtaaaagcctctatagttatatagtagtatatagaccttgaagatttctttttgaagaaaatatgattatactgagttcaaaaggtcgaaaagaaataataaaggtagaatccctttacatgatgtgtggaacaacttttcttgacctccaacttcttgggatcgtgggaaatatataggagaatctaatcggaagttgtacagaacgtgtaagaactaagaaccatattcactttgttgtcattgttataagattcaagattctttgaccggcgcgtgaaaaaagcatccacctataggctcaagattcgtgtccaagaaaatatcgagaaccgatgattacttggaaagtggaccattttttaaaaaatcaaaaattaaaaaaggaacgtagctcatgcgaatagtttagtccaccaaagtgaaatggtagaacatttggtttcagtttagttgtgtgtatttttattaaaggcttcagaatcaatttcgatttttgaaaaatgagtttttatagccatgttagtatgttacgaggatggaaaagcaacctagctagattatcttgtgatatgtgttattgttcaagagaagtaggggcagtagttgtcgagatcatgttattagtgtcgctggaatgttagatattgcccatcctgtctctttttccccatcgtgccctaaaagtcaaactatgcatggtattagctaatcttgaataggtttaattcagtacggaaactctaattgaaaactaccttcatggagtaatagttatcgaggaacgatgatgaggtattagtggagataagcagatttggactcaatatcaaaaattaatggtgggatccatttccgtttcacctaatatacatagtggcaaacaaaaaacaaatataagaagaaaagattcagtatcgagcattctagctatgtcggtaacgtgacaaagtcctttttttcgtttgtctgtttctttaaagttaatcaaatcggccaacgctgcctcaacaacgagcttcctttttctaacgtccctaatttgccacgtccattttctggactagtcccggtttaaaaaatcttcagagatgtattcgtggtcaacttcattaactctttctcttgagcccttcattagttatgatcttatttactttttaaaaatctaaccaagtactgtatattatatatgtggtagccaaaatattatgttaaattctaggctaatccgatatatcaagaaaaatcaatatataaaaatggagagctatttttcacgagttaagtgagagagatgagtaaagaaaggcacgggaaggtgaagagagtgtaggtttccagcttcttccccaagaaataaaatgtatttgactttgtctaagcaaatatgtcgtcactttaacgtcattcattacctagaatgcaattaagatatggcttttacataagccaccaaatttggttttgttgccccaaaatatcccaagaaaagatcaacttcttcttcttaccaaaactgtcggcgtcgtctcctctaagctcctccc

SEQ ID NO: 316 - DNA, 3000 bp, Arabidopsis thaliana
aaacaaaagagaaggcagaaagaatcagtacctagagcagaaagactgttgataaagagctgttgagagtttccagggtcaggtttcaatatgacttgaaattgagtgtgtctttgaagcctattgggattctctccatagcgagagtcgtcaggacgtatgcttggctcaacataagcaacattccatggttcaggaccaagaaccctcaaaaaggtacaaggattcatggtgccagctccgacctcagtgttacttggttgcataacggcacatccaacggaagcccaatattccttcaatttcaaaacaaaagagagtaattcaatttgaattcgtcgaacttttgaaagtagagaattggagatgagtgagaatcgaacgaacctggaggcgttgaatcgcttgttggaatgtaggaacagacaccgcgcgggtaacatcatcgtcgggattacgataggattggtgatgaacagcggcggaggaaacggcggaggtacggtgaaaacggcggcgggagaggaaaggggactgagaaagagagcgagggaggaggaagaagcgaggagaggcgtgaggacgaaggaaagagacgataagaggaagagagaaatggaggatggccatgagtgtgaccagactctttgtagaagagagtcaatgtgtagtgctcgatttttggaagacgagagagatagagagaggttttgtgttatcctttcttccttttttcttttctctctctcgagttcgcggttcgacctaaactatatgattttttcaaaagaaaacaccatttagtctaaaatgtatttgacaaaaaaaaaagtctaaaatgtaaattcactaagcaacaaaaacaaaattgtaagctgtaataatcttgtacatttatagataattattaaataatttcagatatataatcaatgaatgatgaataacaattgaatataagtaattcagttactcacgattatttatagaataggagaattcataaaataaatcgagtatttgtaatccataacttaaaatttctatatcaaaagattacgtacgtagagaaatcaaaatttggaccccgaatataattttgaataatcatatattagcttattgattctcattttataacattttcctttgtcatatagtgaaattgagacacacacaaagaaaagatttttttttttaagtataatacaagaacatttttatttagaccatgctaacatcttcccaattttatcagatgtcccaaaagaacctaatacaacaacatgcatgtaccaattcatatcacatagacagttaacacgaaagttcgttggtttttgtaaggaaaccaataaagcatatttgtcttcagcctctcatactatttgagaggtaaaaaccgagaccattaggattattctttatagaatgttttggtgcctaacaaattttactggcatttcttttttttgccataaactgttaagaggtttatttatgaattgttaacttaatttctttgatcaaacaatagtaagttctataaatgtatcttgtgatctttgactatgatagacactaagctcggactcatgtacatagccaaaacactcatatatattaaaacaataatttcatcggtaaactcatgttgtttccaaatatacaagtagagaaaacgtgtagacttactctgaagggacacgcatatacatactgataaacaaccatcatggagaaatccgagccgtttctctgcaagccaaaccaaatttgacatatatagtaaggtcatgtgctctatacacctagtacctcacattcatttgatatctcctctagagatacatcgatcatagtcatattttcagctttcaatgatgatttagtcattaccattcttgaaatatattggtcgagtttagtccatagatcttcgatcctgtcgtgacaaagccttccatcaattgtcaaaagatctctcacgtgtggaaatactcgatgcgtgttgctaaatatgtgaataaaagaacgccaaatttatagaaaaagcgaattaaaattcaagtaaacatatgaatatttttcaagaaaagtgaattgaaattttattttcatgaaaacttactatttttttttttttttttgaacactcatgaaaacttactattaactcatcaatcttatgccattcgaccacgatcgatagtagaggcaactattatggtacagttacgagatggacaaacaacaataacttgaaaaataatgattttttgttttgtttctagaaatatacacatacggatcttgaatttatctgattgcgcaactagagatatcaacattgaaattcattcgcccaaatagtcaatctggcggtcacatgtcagctaacttttccaacaatgttcattaattaattaacaatctcaaagattttgtagattgaaatacaaatcttctctctgtggtacatttcttgaaaaatgggaaaatcaagaaagtatcgaaaatgtacaaaaataaaaagaaatgaatcaaagtagccatgatcttgacaacaataatcgagagagatcgtcatgatacgatttccctcatccaaaattgattttatttcccttcccaaatcaaacatatcatatgatttcaccactcaccattacttgactattctcaacaaaaaaaatattaaaaaactttatgactttgattttatttttatttgaagtttagccaaaatttgaaaatatgacttttgagaagaaaacagaataaacaaataattagccacgcgctatcagacagacaaaatcccacagatatgcaaagatctctcagaatcctctccccatatcatatttttctcttttccctctccttctttcttcctttataaatccatttattctcctctcatctctcagcaaaatcaaatcctcatagttgattctctctatctctctcacgagtcacgatcctactcttcttgat

SEQ ID NO: 317 - DNA, 3000 bp, Arabidopsis thaliana
ggtgacactgaagacaattagaccaagaacaaatcgtcctagtgaatcattaagagaattagtctgaaagtttgatatattattatagtcgaaaatcctaaaaattctgaaactcctagtttagactcttaagaccagccttgcggttctgttgtcaccctcaagtagtttctgttctggtttgttcaagagcgatattctaatgaagatatataagactttgaaattgttttcacaaggcgataaattaccacttaacttccttgacccttgttattaactgcttccaaacattgctctacgagactcttgatttacatgtttattacatcatattggtaagcataacatagaccaatttggttatcgccaacacctaagcttagtagtagtaaaaaccttatgcatgagctgattttgtatctttcttcagtttggagttgatggacttttcttgataaagctttggattacgagttgaaatccagagaaaagctccaatagcaaagtcacgcttatgagccaagtcaccataagtagacaaaccgtaatctgctaaaaccctgtcgagcttccactctggcatgtcttggtaatcttctttggagtatcttgggtaatgaagaggcatgcgaaacacactcccttcaccgttcttgccattttcaacatccatatatactgtacaatattattatttgaagaatactctttcctgttctgttcttgcttctggtgtgtaaatatgcatgtgtttatatatgttcttgaggcttatttatataaaggtgttgcaagcggtggtttaactacacacttaacgtgtgagtttttgtcacacggatccgtttgtttaccttcttcattgcctttgttaaacgcatgaacatgtgtaaatggaaacattgttgtgatcataactttggataacactaatcattcacacgtacggatggagtttaaaatgtaaacaaaacttcgattcacatacgttctaaatttattaagaatacagattactgtaaacttatatgcctaaatctatggttttaacttttaagtatatcatgattcatgaggtgttgtactgttgtttttcttcattagcatgaattgaaatttaggtagttcttcatacaaaaagttaaagcaaaattatttttaaaaatttttgtgaatgtgtcatcatactaaatactatgaatttttgtgtttccgtttatgggtatgatttttcttagttaatattacgaaaatatacaaaatcttgaaataaaaatgtaaaacctaattggtttaaagtaaaattttgttaggtttgtattaaagtgtgtacactgtgttgtagggttaatttacagttctcatctacaaataacattctaaagaataaaatcacccataaacccaaacacattgttcttggctaattgcatatgttgttcttcacaaaaagaaaaaaacttaagaaaaaaataagacaaagcagtgatggctaggatcaggttcttgagaggtcccacatggtgactcaaagcctgcgacgtgtcatcacaatcattaaacgaaccccactggctaatttagccgacatatgaaggaccaaaaccacacttctacttccagaaacttcgtcacaaactcttggcttagatttcgtcataaacttagtggttcacattttgccacctgtctgtttagtccccacgtgatttatcctacgtggctactctcgttcctaaataatgatacttttttgttggaaccaaccccaaacttattgatactttcgtaactcgcccctattctttgatccaagtataaactcctttgtcattccttatcaatcattcgtcaatagaattaaggtcgtgtcttaacacactttctaaagggaaagcctatttctggaaatatatttttagataacgttttaacaaaaatggatttgatcaagtgaaaactttggtccacatactccactgagatatttacttggcttacaacatatgtcacaagatatatattccaaagagatattttacttggctcacataattcccaagatatttcatatgttttggttttgttttcgatgaagataagatatttcaaatgcttctccacctaaacccaacaacttttgagaattccaaattctgatcaagatagaaattttttatattgtttttcgaattaattgtttttcatatcactacaaaacaaaaatattatattaattaaagtataaaaaatggtactaatttaaattactcaaaataaatgatacacatatacatggtgttatatcaattacaataattgacactattattgaattgtttgacattgatttaataaaatcggtacaaattcacattaatttgcatctttttcaaaatattattacaacaacatttaaatcactatgttcttaatcgtcttttcgtaataataattaaattttgaggtttttcgtttttttagataagaaaaaaataatgtaaaaaaaattgacgagatcatattttggttgatcacaagtgaggaaaatgaagttattatgtaaagaaggattctataatcgattgaccaacattcctccaaagaaatatattttattttataaaaaaatctaataaataattggaaataaaatcatcattcaccaaactttatactgttttacaaatctacgttttagtcaatttcttccccatacttgacctcatgaagcaatgaacacaaatctatgtttcgattttaccatggaagagggtcttagtgatatgaatttaaatgtcgggataaaatataagattataaaactataaaggtttattttgaaatacagcacacacaagaaaaaaggcccatcaacctcgcagtcctaattagataaatacacgtcaacttctctgggaacaaaaaaactgatattttctgattcgtcgtttcctttctactttcttcttcgtcaggttttcaaaactgagaaaa

SEQ ID NO: 318 - DNA, 3000 bp, Arabidopsis thaliana
gatgtcgaatgaagtttttggaccatagaaaagatgatagttcataggaattaaaaaaaggaggataaagtaaaattagagaaggaaggccacacctgattacagaacaaatggtacaattctcatcacccaacaaaaatcagagcctagtatgcagatcacgtacgatcagtccaagtacagataaagtggacgcctataaaaacctagggcttcaatcactagcccacaaatctgtggaagaatcttatactgggccttttctttactaaataaaaagtaatttataacgttctggactttatttgagtataggtttctttctgcagttattaaatttactgggttaagagttcatacgtgttatgtgcatttcgctttaaaaagtcttagctcctgagatgatcgacaaatgagttgcggccaatattgggtcattagaaactattgggctataactttgggtccattgggccgaagtagcagctagaagctagtttctgttttctctaaaattaggcctaattcaggttactcaaaaatctagaataaccttatattactgtaaaatttgagaaatctggttgcataattctttatcatagtttctgtagagaacagaagcccacatgttatataaaactaggggttcaatggttacgacttacgatgtacgtggttctcaggcgtgagacccagcaagagcaaaggagatcgaaattattagttattagatgaaatttaaagtaatgagtttcaacttccctttacattgggaggcatttgtctcccgatccattaccaaaaaaaaaaaaaacttccctttacattttatcttaacctccttttgaactgttgtttagttagactcaaaacggtgtaatctatcaattatttttccattataatgactgtactttatccatttaattagtcttttttatttacccaagtggaaataagaaataacctaaaaaattcgattagtgcatggggatacagcaactttgaaaggtccaacaaaactgacctttgttgatcatattgatattccggtcataatattatttggtctttctaaggacatctcaatcatattaattgtgttttttttttggcagtccaaaatttgacttaatgaaaaaactcttgtggaaaaatcatagaggaaaaccccaataattcgaagatttgcattagataaattagaataatgcttttgaccccaagatgcagtatttattgctccaagttttgactcttcaaccaacttatatacgtatgacaatatgaccccaactcccaagttgcccaaagtccatagattctcccccacaaagtaataaagatcgcattaacaaatgaaaagaacaaaagaaaaataacaatcatgttttgtgtgatcgattactattaaaaattaaaaaaagatgaagaaagatttgggttgtataataatggcaaataaagtgaagccaaagagaagacattttttttttttttgtcgcacacccaaagggaacgaagattagagaacgcgtcattcactctctcgtcacgcacctctcacacaacatgactctcctccttggtttagcctaatttgctttgttttatttttcctgattctatttgtattttatttattaaatttgtattttgtaatgtcaaatttttattatgcttctcttttccctttttcacagaagttgatcgtttactgttttatgattttctaaaatttctcacaacatcaatacttttttttaatctcctaatggtatggtatttgcttgataatctttctgcctccattaattttgagtttggctaggatttttgatggaaatagacagcttaattaaaatcatgtaaacaaaataaaaacaggcgaagcaagcaagtggtaaagttgactggtaaaagtctctttcacgtgctcttgaaaagcgcgtgctagttgtgtgtgggtggatcacgcacacgcgtattgaagtgttaccgtcttaatcggtcagaattttgagtcgagaaattaaaagtggtgaattcttcttttaactccccccaactacaaaatttaccatttccacccccaactatttccataatcgaattattagacttcaaacctaataatttaaaacgaacaaacatattttcttaaatgaaaggagaatttaatagcataatcaattgtttgaccaaaaaaagagaagcataatcagctgttttccttgtatacgagtagaagagtcagcacaagagcgacaatggctcacctttgaaagtttggtttcaaccttttgacttttgacctaaaacatatccatattcgtcaagaagaacaaagaaagtattccaaaaaaaatataataaaaaaaaaaagaccaagaaaaataaaatggaaagaggaaacaaagaaggcagcttcctctctccttcttcattgcaaagaaagcaccaccttttaaagaatcctcctcacactccattcttcttaaaaaacccaccacaacacaattcccacttgtttcttcatcatcacctacttcaatcaaaaaacattccaactttcttctcaatttcattccaggtttgtgccctttcttcttgaatcttcttctatggaacttccaatttcgtctacttatgggcttaatttggtttacaagtcttgctatttctagaaaactcgtcttatcttgagtttcttggacagaaattcttgagtttcttgatttatctttgacttgtttcttgaaaaaaaaaaggaaaaaattttggttggaatatttcaacggagaagagtagaaacggtcgttggcttgtcttagtagaaagtagtttactttttttatatccgcaaaaattgcggcttcaaattctgcttcagaagactcttagaaaatggaaaaagttacaaacaaagaataatatttattttctgtcagtttttctgatcatcaattacttttcttgaatctacaggatagtatt

SEQ ID NO: 319 - DNA, 3000 bp, Arabidopsis thaliana
ccattaaagcccaatccagatataaaggaaagcacttgtaaaaagtcacgtgagaataacattttcaaccacagtggcttgtattggcccaacgtttttttcactaacggcccaaaaagcccaaatcagctattgattagtggaggagtactcatttattaattcctcctactaattggggtttaccaacttaacagaaaaaatgcatcagttgtgtgagttgtcgaacaatcaaagtgatttaccaacaaaatataaataaaagtaatcattaacttgattagatataaaattaaaaaaaaatcggttagtcaaacacaatgtttaaattaatgttgacttaactcgtttttagtaatattgtatgtatctttataataataaaagaatgcttgggtttgggtccacgcgtttttgtgatacaatgcctcgtgcaggccacttggagctaaatattttttttgctaaaaaaactcgtcctcgaaggtttcacgtggctcatgcacccctgactgggtcaggagaatcttgaccgttggatcaaagttgaagcatttataatagctttgaccgtccgatgaatgactacaaagattgtgattcgttataagccgtacgattgactaacacaaagaggaatcaacatcacgaggcgagagataatggtaacaacggcataaaagcatttttctcgacagctgtagcaaactccacgtcatcttatcttactcgccgtgtgaaccgttgattttatgaaaatttgtcaaccttttttactcgcggagatcacgcgctcccctcgtttggcacgtgtgtcacactctgcttcactcgtaaaattctttttccttttcttctttcttattgttcaccatataaattattttgaaccaattttttttttacaatacaaattgtttttaaatttctatacaaattatatattatttttatatttatgattattacataataattagttaaattttttcaaaataaatattcttaaatctgcgtgtttttagttaaaataatttatattgtgaaacggaaagaataatattttttccgaaaataaaatgtttagtaaatttgtgtgtttatttcaaaaattatgttattgtttttcttttttttaaatgagttgtagaatgggaagaactaaataaacacactactcatattattattttttataacattacctacatgtgctttgctgttgctattctcaaaaggtaatgaatggtacaatagtatcccatgtttagagtatgtggcagagtgatcaacactatggtgctaagtgacaatcactatctttctatctacatactttttatattgcatttaagcacattttttggaaaaatataaaatggaatacatatgtgttatccatgaatggttctttttttataaacatcagttgttagattgactattttgtaatgtcgaaagctcacaacaaattaaacttttattcttatcccttaacattataattttttttgtctaaattaatcttgacaacttccaattccataatcgttggtgtaaaaagatttaagaattgtttacttcatcttgtgcgcatcgataaaaagtgggcactagtacgaaagtatggtttcccactatttaaaatcaaatcaaaggatccctaaaagcgcgtgtgagagacgcgtggaaatgtccaaaggagtgtgaggttgacaaaagatgaattaagagattattcaaagcctttgacattttatcaaagtcaaccaaatacaagaaaccggaaaccataagtggttttagtcactaggcgacaaagacaggataagcatcgagataccttcttcaagcacatacttttctctctttctagaattgcccaaaaaagccaaagagactattcctctctctatatatatatagaatataaaatattctaatatacgtattatataatcggcatatacacgtattgtgattccgacagtgctcatctttttccaagtgtgttcatacttatttgcttttaaaacaagatacagagatatgtttaatttagtaatgtctaaacaattgctatcactaaaaggaaaatatgtcaaataaacactaacatttagtaaaattgtaacgataggttggcacaataatggcatcggtttatagaggacgattcctattagtttgctaattacaacatctagtattagttttgtgcaatcgtcacatgtccttcttcatttcctgttttatatacaaaaattattcagtatgtttacaccatccgtacacaaattttatttttagttaaatatattttatagtcacaagttgtgtgactcaacaaaatattttcaggtctttttttgtaattcataaattcatgtctattaatattttcaactaataaactaatttttgcgagataaactttgaatggttacagcgatccaagcggacaaaccatctacaaaccgaaccgctttttatttatcattcacaatctatagttcgtaatgaagcagaaccaaaaaaacaaataaatttgatgcggattgactttaaactaagtttgcagcggtttgttctctgtcctaaaaaatagtatagattggaccgttgacggattagttcgcactaaccacaacatatccgtctcaaaaaatagtatagactgtactgctgacggattattccggattaaccacaatatccattcaaaacaataagttgatatgtggaataattacaatgtaacaaaaagagagaagaaaacaaaattgtatattatactgtatttgaatcataaataataatttaataaaatctttcctccatttttttcaaccctttttttattttcgtccatcttcagtctctttataaacatatctctctacccttcaaaagtcagcgctctcttttgtctcctctgcttttttctcttctctcctcagagattcgaagctttttgtctcccctgagtaaccaaattca

SEQ ID NO: 320 - DNA, 3000 bp, Arabidopsis thaliana
gtttttaaagttgaaactgtacaccatatatataaaagtgagataaatgtaagaaatgcacgtgttcaatcatatggttgaaatagactggatacatgcattttgattacttttacacacaagtatttatagaatagtattatagtaccttcgtagaaattacatattccaacttaattgtagtatactgttcagaaagagtaactatttatgtccaattgccaaaaaataaatattctattaaggaagttattgaatagttttgttgaatggaattcgagaagaacaatttaagtatgaactagtatattatacgatcaaacttttcgttcttattttattaactgaactatgaccgcgatcacacatgttaacaaaaaattaacaaaggtaaattaaaatgatgattaattatagaataataacgttaaacatatgaaaacttttggttcttataaaatttatagaataataactaaattagaacaaaaaattaacaaaggtaaattaaaatgatgattaattatagaataataacgttaaacatatgaaaacttttggttcttataaaatttatagaataataactaaattagaacaaaaaattaacaaaggtaaattaaaatgatgattaattatagaataataacgttaaacatatgaaaacttttggttcttagaaaatttatagaataataactaaattagaacaggaaatctcacatattaacaaaaatttaataaagaaaatatagtatgaaagtaggacatgttgtatagtggttaatactaatctcgtctaatttcgttaactacgttttagaggcttaagggtagtttacaatttatgtctcttgttgtaaaaaaaaaacatttacgatatttacataatcgaacttcttcactgacttttttttaaataaaaagaatctaactgacatcctctctagactcagttaaacaaagagtctagaaattagtttaaactcaaatacgtaacataagcctagttttggaaacatgtggacctctaggctctaagttttcatttgttgtggattctggcatttggctgttttctaacacacaactctggtgtaacggtaccattatcccagtttaaatatgtataatgcatgtttatatatatatatataaaaattaaagactaatgataagaagaaatcaatcaataattgattttttaagtactagatttttttctttcagtttttgacatcctagatttccagaaaaacttgaaaaactatagctaacatgaacgaatatagcaaacatttttttttgtaggaacgaattagtaaacatgaatactctgtaattattgagaagttaattatggattcgtctgggcaatacccattgatatttcccttgaaacaaagatatttgtaataagaacataagtactggacagacacacagagctgaactagacatgtaaattatttacaaatgttttaaataagtgaaaacgttgatttgaaaaatatattagaagattcatttaaacctacatctaggataagccttgagcaatatgtttcatatatatagtataaattgtcatactgatagaaaattgcatatgtgtgtgttaggctttgtaaattagtttcaagtatgaatcaatatctatgatgaagtaagcacattcgtacgaagacgtaaaatggatatatcacgttcgaaagcagcaaccaaagccaaaagtggtcacatggtttgttgttgtaaaatatatatttttggttataattattgtagaataattgagactagaacttaattagtattacgattccgctaattacgcagcccttatctttcgagactataactttaatattacgattcctctgatagtctaattatgcatgcatttttgtgtgtttgcgttttagtttatgttttatacgtaaggtaatatctattcacttacaaatgaagcgataagcttataattttgtagcttgtacccgtagacacaataaaaatgtatatttatcggtgtaatgttttactatgttcggcaacattttaacaacactttagttttcagtgattatataacagctagaaatgaacatatatatagtgttgatcattgaaataaaaacagctttctggtctgagatgtataaaacaaaaataatggatattttatcccgaaagattatgtagagattggatgaacaaattactggttgaacttgaaattattggactttttttttttaaatgtttttgggcagctatacgagaattccatgggtctttgtccacaaaatgttggcgaccatacgaaaacatcgtcgacattcgacaaagagaatctagtcttcataactaaaatatttttaatccaaaaacaaaaataacatccgacgtacgtgaagtaaaaccagtgtttttcttccatcaaattttgcaactatcataagtttttatataaaaacgtgtgtttatccaaacattgagttgatacggccgctaaattttgatattgcaaatgcatgcatgcgaagaattctcacaacgagtagtaaattaatcaaatattaacacgaaaggtactttataataactattactaaaccgtactaatattttgataaacatgaatcgataaattcttgtctaatcatctgccaaagaaacccaatattagagcgcagcctaattaaaatatttgtgttttgtttttttaccccagctgccattgatgaaccacacgatcaaaccgttgacgaggggtttataatctaatcaaacggtgtaaaaccggtgaaacacgcgtgtacatacaccatcccgcatttgataattttagattttaagtttaaaaaatcctgaggatgttgccttgaaagagtctctcattgacttgactctttcctataaatacacctttccactctctcttctccactgtcaaatcaaatccctcttcctcttcaattctctgtttcctccaaa

SEQ ID NO: 321 - DNA, 3000 bp, Arabidopsis thaliana
ccacttgctctacttctttccctttttcgtcatttgttcttaatcgcagttattgaattccacaaaccacattaactaataactaatctgtacttattaaagttaatagagtatggtgtaataccacttgactaaaaaaatactactagattattaaaattgcaaacgatttgtactaattcttgaattaaattgtgcgtgttttttccatgaagttctagtgatgtgatgtgggattgacatagtgtaagttattaaaataggggtttggatttctttatcaatatgatttgttaggtggaaaagaaatgtataggttttaaaatagttttcattcttccttaaatatcattatcccggaaatttagttatttctactttaaaatagtttgtttaatttttagatatttgcttggattatgtgcttactttgataattgttttgcattgtctccaaaataaaatttgtttttatatttttattaggctagtacatgttatggttaaaaatagaaaaatatcataaaaactgctaaatttagacattttctcatataaaatttttattttttttgttctatataaaatcccaaacttttcaaatttgaacccgagcaatggctgactaagacctatacgataatttagttaaaaaggtcgttgacgacatatttttcatttgattaatttttgaaattcacacataatagttacaatttttctaatttctaagattcatagtataagtttttatcgtaataaagatatttttttggtaaataacaattaacattgttatgatacggacagtatatatatttccatgtagcatttttttataaaaaaatttcattaacataagcaaactttaaacacataaacaaaatataaataatttactcacatatctaaaattaaaagacctcaaaccaaatagataataaaaaaacagaggaaggattcgagctttatgctcaagagagagggtcgagtttactctgcaaaatgttctgaatatacaatattaatcatgtcggagaacaaaaagactaagagtgtaggcgagaccgcgagagttccttttttaaagcaagtagataaaaacttggaaaactagcttgagaatgagagatatgtttatattgcggtatgaatcttttatctatctaaatctatgttccgaaggaattggtggaaaaccatgagctttacatgtaaagaatgatagaccaaacctattttgaaaacataaaacatgtagcattttttatgatcgaaacatatcatagagtagattattgagtattaatcgaattctatttctatgaacaaactaaaatcctaaggacacttggacaaagtgaattgtttttttgtttgttctcctctcctacataaatatacatgtgacatgagataatatgatttctcatattcacgcattgatttgtttctaacatttctatagcatttatgttcacaacttcttgatataatagctgccaaaaaaaacttctttaaatattttcttgtgtttttattgccaaaaacaaacgaaaatatcaaataatttttctcacctgaaatcaaattactgaggatgataatttaatacagatattttgtagaggaccgtggcaattccgtgaataagtaatgtaatgaagggcaaaaatggaaataaaatcaaagtttatgcccaatatctctctccccatctgatgatcactcctttaaaatcaccatcaaagaaattccaattttctcggatttttatttcttatatacaaatccctaaaaccctatagccctctttcttcgtcacctactactactaactccaagctcaagctcctctgtttcttctgtaagtctcaatttatctcatcgaattttccgagaaacaaacaaaaaccaatctttttcatagaaagaatctgaatttcgtgtttatacttaattctgattccaaaaaaacaattctagatctaagatttttatttcttgatgagaatttcactgtagaaagaagtgtatttgttcctttaatttgctttaaaattttggtttcatataatctcaaagccaagagcttgacacctgtgatctgcatagaatccagaacacatcaataatgattcctttttaagaatttttaaattgatttaatcttcttgttggttactatgaaacaactctttttctttcataattagaaacaccaaaatctttatatagagaagaaaagcttaaaactcgatttctgcattttttgtcttcttactctttaaagccctccattgataatcgcttcagccgaaagcagttgattcagcttaattatttatcatagcttctgattcttcttctagctccttcttctttaatcacgatcattaactttaaacccgttttatcaattgttgtgatatgtcagatctacaatgagtagagcataaattcgaatcagaataactgatatcttaattatgtgtatatatgaatgaaagtcatctgtagaaaaagtcgataaggatgtaacatatatatatatatatataagcatttatgtatatatatatgtgtaaagatttgttcttatgagattgtttctttgtttttgttattgcaggcttgtggttaaaaatcatttcagacacagtgcttttgatgactctctgcaacaaacaacagcagctgcagacaaagcttatacgaagctgtatctactgactttgatggtgaaatatcaaaaaccctaaattaattttaaaaaaaaacacattttttttcttcttttggtttttcctctgagggtattcatcatcaatgcttacaaagtacagtgggtaaacaaaacaaaaacaaaaacccatttttttctccttctttaaatcccaaaccaaccctaaagttttgatttttaattttgggggtaaccaaaaaaaaacaaaaccctaattttttttctttagtgatgagattattggtgatgatgaa

SEQ ID NO: 322 - DNA, 3000 bp, Arabidopsis thaliana
ttcagcaaaccataccaacaaaaaagacagagatcttttagttaccttatccagtttcttgaaacagagtactcttctgatcaatgaactcattttctgctttttctgaaatgtttggctccgattacgagtcttcggtttcctcaggcggtgattatattccgacgcttgcgagcagctgccccaagaaaccggcgggtcgtaagaagtttcgtgagactcgtcacccaatatacagaggagttcgtcggagaaactccggtaagtgggtttgtgaggttagagaaccaaacaagaaaacaaggatttggctcggaacatttcaaaccgctgagatggcagctcgagctcacgacgttgccgctttagcccttcgtggccgatcagcctgtctcaatttcgctgactcggcttggagactccgaatcccggaatcaacttgcgctaaggacatccaaaaggcggcggctgaagctgcgttggcgtttcaggatgagatgtgtgatgcgacgacggatcatggcttcgacatggaggagacgttggtggaggctatttacacggcggaacagagcgaaaatgcgttttatatgcacgatgaggcgatgtttgagatgccgagtttgttggctaatatggcagaagggatgcttttgccgcttccgtccgtacagtggaatcataatcatgaagtcgacggcgatgatgacgacgtatcgttatggagttattaaaactcagattattatttccatttttagtacgatactttttattttattattatttttagatccttttttagaatggaatcttcattatgtttgtaaaactgagaaacgagtgtaaattaaattgattcagtttcagtataagtgtgggctattcttaaatgcaagtatttttagagcagtaacaaaaaaatgttgtttaaattagagtataaaaccgaaacaaccgattcagcaaaacctccaataatagaccgtacaccataaacagaaatatgggtcccacaagagagcactgtccgtagcttccccttcattggccctctacgtggctcctcttgtaaccaatgtcatgtcattttcaagttttactttctttttttatactaatatcttgtttgtcgttttctgtaccttaaggtcctaaaccactttctttcgcgcaccattccttgtcgtattatttctccgaatatgtcaataccgtgagacgacaattgatagcgagaggtagcgagagagagaaacgttcgttgtgaagatattttattgctgttgttgagatttgagatattttatagctattattggaatttgaaagtgatgtataacttgctactatatcggtctaatccttggcttaaaccagtttttatttagtaattttatgctcctgtattattattcggtggagtatttttttctcaaaaaatatatgagtcgagtttaagaaatatataagcgaaaaaacaaaaaaaatatatataagcggggttaatagatcaaccacaatcaatttaatttggactttagaattaataaaattgtttacttcgtaattattattatttttgttgttctggcaaatctgataatccagattattattagacaagtagcgaagggacggtgaacatttatgattttaatttgtatgttgtaaggaaaacaaaacaaataagttctgtaaaaaaggtttacctttctactttgccggaaaactcaactcacggtggcgtccggcgagttttcagaccaaaaagaaggttggaagaaatgaagatgaagaggagaggacaaaagatagagatggtggttgaacaaaagaagagtaaagaggacgaagacgctctaagtctaagccaagggggagaagaagagaagaggtatgaggaggaaccatacttttgttagagagatgctggaaattgtgatcaactacatgcaaaatgtcttttcgcctaaccacttaccatatttgatattttccttttgccaaattacacaaaccctatcttgtctctcacatatatatccaattaatacacccctgccacttgttaattctcgaccatgtatgtatacttatgtaaagaatatccaaaagctttctttttgttccttcgattttaagcaacttgtgttctcatttctcaatatcttaaagaaatcctgagtaaaaaagtttatagcctccgtgaatcttaggaaattactctagcatattcaaattttttgaaacaatatataaatttttctgaataattaaatttacatatctatgctacgaaacttgattaattaaatcaaatatatatatatatatataataataataataataatataacattttttttaggacacaaatatctaatctcactatactctagaagtatttgcaatgcacgatatgtgaatggagaaaagacagaaagagcatttgaaaatatctcgtttcacggatcattatgtctaattattttaccatagaaaagcgacaattataaacaatttgttattcgtggaaaaataatatttaataatggttgtcgtaccctataaactacagccacacattcatacaataagaagttaaaaaaattcataccctaaaggcatcaaccagtgaagggtcagaaacttcccaagatgggtcaaaggacacatgtcagattctcagtgattgacagccttgataattacaaaaccgtgggatcgcttagctgtttcttatccacgtggcattcacagagacagaaactccgcgttcgaccccacaaatatccaaatatcttccggccaatataaacagcaagctctcactccaacatttctataacttcaaacacttacctgaattagaaaagaaagatagatagagaaataaatattttatcataccatacaaaaaaagacagagatcttctacttactctactctcataaaccttatccagtttcttgaaacagagtactcttctgatca

SEQ ID NO: 323 - DNA, 3000 bp, Arabidopsis thaliana
tgcttttaccgccgccgtctgttcaatggaatcataattatgacggcgaaggagatggtgacgtgtcgctttggagttactaatattcgatagtcgtttccatttttgtactatagtttgaaaatattctagttcctttttttagaatggttccttcattttattttattttattgttgtagaaacgagtggaaaataattcaatacaaaacaaatcgttttctacttctttgcttcacataagttaaaagtcaaatatttaacaaaaaagatattaaaagtcatattgtagttgctttcaaggcaaaatatgtggacagatcattacacgtggatgatgtttgtaaatatgccacaaaacctgcattacattattttattctatctcatgtaagttacagatcttacaatttagcaacagaaagccacaaaatattacataaattggctcgtctcgaatctagcaaccaaaaaaattcagcccagttcactataaagaatataaaaaaaagtttcctaaaatagtgtataaaaccgaaacaaactaattcaacaaacccgaaataaacaaatccgtacgacaaccaaaaatatctttcagatgggttccacaagataacccagtgccaatcagaattctgaaagcgtggctcgaccgcggaaaccattgtccataccttctcttctttgtccccccttacgtggctcgctgtggagtctcgtaccacgtgtcgcgtcacttcactctttactttctattttccactaaaatcataatttgtctttttcttgaccatacccactcttttttcttctcgttgtcgtcttgcttctcctaaatatctcaaataacgtgagagacttgagtgtgagaggtaggtaacgaggcagactttttttggaagcgaatataacttatgctgatattttatttagctttctgattggagttgagatattatataggtattattgagatattatatacgtattattgagatttgagatattttgtagattttatagttctatcggactaattcttggcttaatccactaacatgtttttgtttagttaattaaactgattattttctgcgctatagttttgttaaacaccttttagacgtaacaaagcaattacgcttgatcatccatcgtagactctttttctttttttacatctcatagaagttttgtttaaacacagcaggaagtaaattattttcttattacgtacgtatgattgtttttagactattttagtactttgagaagtaaaattggggatacgagataaaagacaattgattaacatgctttttattttgacttccgaaactaatcatggttgtctatgtttataaattgtgttctttttgttgaaaaactcagataatgattaaatcagtagcgaatggatggagaacacatgattttagattgcataccgtaaaacaaaaaaaatcatgatggatgtagaacattcaaatgggtcaaataaatacgtatgtgatcaaaagaaagtatgtgatcaaaagggttagcacgagtaccttgggaggaaattcttctaattatgaattatgcaagaattttcgtcaagggaaggtggggaagaggtagctaaagaatagagaatcatatgactaaggacgtggtggttgaaggaaatgagagaatacatgaagaagagaaacttctttgagtgagaaggaagtgcgctggctggagagaaaagagagaaaagagtttcgagtgagagagagggcgttgagattgtgatcaacttaatgtaatatgttcttttattacattttctttttgtcatatactcaaaccttttactattttgtctcataaatctaacacaccccaccatttgttaatgcatgatggtagaaaatattaaatataattaactacttttatgtgatcaaaattaggtttcagactcgtttcgcgatccgatctacaattacaactgcatgcttctaattgatctaaattctaaattttttatacatattaaaaaaacaactttttgttaaattctcaatcatcatttttgtgattaacaattttttataactctaaaccaataatatttgattatttattttatatgtataatgatgattgagaattttaattagcagtctatttagggttttcctaaagttacaatatgttgttacccttctagttaaattttccaaaataccatatttcataacttttcaaactgtttattaattcaaccgtaaaaagcactaaaatgttacatttgatcattcacccaaattaaattcaaaagtttttccgccaaaactacttggtgacttacgtgcttatatacggacgactattattatgttctatacttttttatactttgttgcacaaatatctactctcccaattcatattctagaaggatgtgctataagaatgggagaaattacacaagaagagcatctttaaatatcctctcacaatctttatgtctaatacacgggtgaacaattaacgacaatttctttattcaggaatataataatgaataacggttaccctacacctagtacactaaatccttaacagccacacattcatacgcaaagagtttataaaactcataaaggtataataataacgagtgaataagtcaaaaaaagtcttctctggacacatggcagatcttaatgagtgaatccttaaactactcattttacaattgcttcgctgtgtatagtttacgtggcattaccagagacacaaactccgtcttcgccttttcttttgcctctaaaatatcttccgccattataaaacagcatgctctcactccaacttttatttatctacaaacattaaatccacctgaactagaacagaaagagagagaaactattatttcagcaaaccataccaacaaaaaagacagagatcttttagttaccttatccagtttcttgaaacagagtactcttctgatca

SEQ ID NO: 324 - DNA, 3000 bp, Arabidopsis thaliana
atacctctcaagaaatattgttgcatgaaacatatcgtttagttggcaaatgttataagttataagtttataactatactaacagttgactttttattaaggttataaaaaaaatttatatagactaattttatcttcgttaaagagatttctttgtactaataaatacttgaaatgagttataagcaattttatattgtactaaatgtttcccaccgaactcgataataaattaatgtaaccataccattccacatgtgatgctcatcgttgcgatgtagtttaccactccatacttttctttgttacccatacatgaaccttttttaatctcaagtgacattagttcaatagtattttacttagctagactagtttagcttttcaaatatattctccatccccttgatcaaattaaataacaatggcgtacctacttttcttagatgtttgggtttggctcatcagatagttatacttaattttgaatagtttttagttgatcagagagactagtattgcagcggttaaaatggacacaattttcttactacatttacaagaaattataagttgtttttttttgttaaagacacaaactattttgtttttcttcttatagttatttaacgtagtcactatatttacaagaattatttttggattattaaaaataaaaagatatattttaaagtatatttattctatggtctatggataaatatcccattaaactattagacaaaaaggtatggctgccaaacgtaaatgtcgaataaataaatatctaagcgagtagaaatcaaaagagaagtaatctactaaagtttttcaagtccgtctttcgattggattgcattagcaagttgagaggaactaatgtctaaagaagcattaatgagtgaaatgtatatacatgttccttattattatgcatatattaaatcgctttcaatcaaatttgtgtgccttgttttctttataaaagaatacaattcagcctcgtaggagctgagctacgacattgaagatatttttggtccgtacgtattactatggtttaataggttaagtgactatgaaaacgaagacattgtgtcgtaatcgtgtgtaatttcactatcttccaaataaagaaatataataattgcttcttgaatcggatgagctacacgtttttagatatttcgcaacctgtcttcttcgttagatctaggaaacattgatttatagaaatatgtttctattatttctctattattcattcaacatgttaatatcgccaccactcaaatatattgaccatgtcaattgtttgattgaactataagtttgataaacaattgtcaaatttataaaaatttaaaagagaaaatacatttatatgaaagaaaagaaaagtgcaaaaaagaaagaacaaaggataaatgagaggtcgattttgtttaggaggatatggaattgcttccaaatttagcaaagaaacataaatgtttttgcccctataaagtctttaaacgttattccaaatctgttccaacatgtcctcttcatccgacacatttcttatcctcttctctaattttttttgctaaaattaaatcgaaaattgaaaacgaatttttgagaactatgtaagatattttttttcttccaataacaacaaattaccaaacaactttttgtcgttttgttactaaataagtggtacaatgaaattataagtgatacaataaaatcatttgacttagatataataatattcaaattaaaatgacaacaatacacaataaaattatgagaattcttcgaatcatatcaaaaattaatttttttttttcgataacaataaattattaaacaactttttgtcgtaagattattttttcctgataacaataaattattaaataattttcgatcgttttgttgttagataaatgatacaatgaattcatttcaacaacttagatacaacaatatttggatcaaaatgaaaattataaacaaagtatcatatatctttgtatcatatcaaaaacaagatcattttttccgataacaataaattattaaacaactttttgtcgttttgttgctagataagtgaaacaataaaatcattttgacgaattagatataacaatattaagatcacaatgaacaatagtaaacaacaaattatcagatattttggtattaaaaataagattatttttccgataataacaaattattaaacaatttttttatagttttgatgctaaataagtgatataatgaaattgttttgacgatttagatacaataatattaggttcaaaatgacaatactaaacaacaaattatcagatcatatcaaaaataaaattatttttttcgataacagcaaattattaaacaactttttttttattgctagataaatgatacaataacctcattcgatatatataataatattcaaatcaaaatgacaataataaacaataaattattatattgaatcatataaaaaataagagatacatgcaacgaataattaaacaaacaaattaagtaataaggcaatggatagactaattaatgaaactaaaactgtggattatctattttgtcgtctttcggagaatctaaacttcgaccgacttcaacgtatctaataatcctaaagtaaccttacgctcacagttcggttactttaaacttcgtcaaagtcattttgataaacgtccacatcacgaaacggtccacgtacgtctatctcgtggataagtctccagccgctgtttcacatgcttatctcacagctttgttacgataacctagtcctatgctaatatctttaaccatagttaaataattttaaccaaaccacggttaagtgtttcaactacataagtagctttgccggtgtattacaaacaaacaacacaaacaaaaaaaaagaactctttcgtcgactaatgtgatttattgttcaccggagtattaaagaag

SEQ ID NO: 325 - DNA, 3000 bp, Arabidopsis thaliana
aacaatatccaacttgaccaatatatctttattgttcgtcaactgtcatcgatctatatcactttacgtataggattaatgtggcgtaaaaagataaagaagtttggtccaaatttcaatatcaaacttctagtgatgagaaatttctatttggtctacatcggggaacagatcattccacttatgaatccccattactaattttccattcctattacagacgttttacgtagtagggaatctagtttattaatatacatatcacatagattaatcttgattgtttcgcaaattttaatggttttcggaaacaaaaagggggtacaaagtgagctttccgaaatagtgtagttcccagcatccaaatctctcaaaattccttccacaattagaacgattgttcgttcgttcgttttcacaatgtatctcgacctcttttagcaagagtttgctactaaactcgaaccaagtggaaacatgtgggttttgcaatctaaattgaatttgttttgtcaaaaaaggttcttatatttagtacactgtaaaaaatttcgtttctaataacataaatacctagtatagtgtaatggtgttcagagttagcatgcaaacttgtgttaggaaaggatatcaaaagtctcttgtttcaacaatttttattttatattcaaaaattattatgatttgatctttcaagttgattcaattcatgaagatcacataaagcttcttctctgaaatgaatgtcacatggaataattatgtattgaagagcaaaaaccgcatatagtaacctagcttaaaccgaatatacccgaagtcaagactttaatgagaatcagactaaatcctgaatttatttgaaaacaaatcatatgatttggtcttcggtccggtaaaaaaactcagataagtttgaaaacaagttttaatatttatactatatgattccgtcttaatcaaaattgtcaacttacatcaataaaatcaaaactcattttaactagattctaagaatctcatcgaacaatcgatctttgtaaatcttcatggaatagtggttagcatttgtatcattgagtttgaaagaaacggaataattaaagatgacactaaattcacaactttgaacaaacaaacaaaaaaaagtgacaagaaaaatagaggtcggtgtcggagccgcccaaggtggcaacttgttcacacctcataataaaagcttctcacaagttggaagtcgcggtcgagtccagtcaagattttgttgcccttttcccgtgtgggctcaccaccctctttgtcttcttctccccaaaaattttccacgttttttgtttcactctctcaatttatttatattttttttgtcggctcatatttaatttgtgttaattaacacttccttgattagaaagtttttttgtaccgacttaaatttatcatgcaatgtgattggtcgctttcccaaaacaatctctcaacgacaaaaaagtagtaattagtaattaaatacattatattttgttgttaaatagtactcattctatttcaaaatataaaatatttaagtaaatatcacacggttaatgaatttaaatatataactcaagtatagtactaaaaagaatactttaacaaacaaacagaaacctattgtacagtaaaatatcaatcagtgaattattaatcaaatagtaagggaaactaggatataatagaaaaagaattgccgacctacaaatcagagtcaatggtcaagcaagtcaagggaaagttcgtaattgttatggatctggagtctggacaaattaaaaaaaatttgttaaatagaagaggatataaagggaacacagatcctacatattgaaatttatgtatgacgtccaaatttttcttcagcatgggacactgccccgccgaaattattgatttttcggatctttcttctacttgcttcttttttgtttgcttttataagttttgcatagctaattcttaatttcttatcatttatttctagttggtagagacttataaattgaacgtttcaagtctttggacggtatttgagatttcttgtaatttcacttgtaattgtaccacctaacagtgactaaagcagaataaattacgattcgtatacaacaaagtattcaaatttctaaatgtggatatattattgattttattttgggaaacatgtttatgataatcacctatatctcctctatagtctactagaaacgatatttgtcaccttcatcgtacaagactataatgtataattctatccataatgaacgatctagtttttaacatgtactatagagatgaatgattacgacagtaaatttaacccatgcatacgaaaatacataccgatagatataacacaattcagaatgttttacacaatcccatatttttagccaatcagtgtgattttaatagacagctttctatgtcttgttgtgctttttcttcttctttttttcccaaagtctttaatgtcttctggactttatagaagacagctttttatatgttatcttcactttcgaacgactttccttcctaacatatcccaaaacctatctctttaatttattcctatcgtacttacagcttttattaaaaaaactttcttattttaatcactaaacaattaataaaacatttatttatgatttttcattttcgttaaagctcttttattaaaaacttaatcacaacaaatttattaatcttaaatttgaccttaggataaaatttatatattaatcttatatctgttatacattaaataaactttaatttctgcgcaacaaactaatttattatttatttcttgtctctgtctttgtagttttagtataaataaagccattttgctccgaggaacttctcattcagtcggaccaacttgtgaccgaagaaagcaaattgagactacgcaccaactagtcctttggtttgtatcttaagataaaggtttctttt

SEQ ID NO: 326 - DNA, 3000 bp, Arabidopsis thaliana
atctataacgagttaacatgttgccagtttgaatcaagaagcttggatgatgaatgaatggatcggtttgtggtacaattcttaaaattgtagtagaggagacagagaaaaaacatgataagactttggtatttacaacttgacggagacaagacagtaagccaaatctgtcacaaaaacactcaaactcttttctcagtgttttgagtttaaagagagacttattcacttcccctttcgtaacacttatttgtctcccaaccaaacagtttctgtcctttcccttgtcctcccacgtgcatctttatatctcatgacttttcgtttctagatcttgaataatgtcttagtggattaggtttgttgtcggtaaattaggtgaccgtttttttcttatatttggaagatcgcgggatgaagcagatactgagtttcagggcatacacacctaatttgaaaatcattgttagtccaatttcactttaatcttgtttacaaaaaaattgatctgaaaatgttgatgggataagtaaaaatgtaagttttgctagtagtcatgatataataatagcaaaaccagatcaattttgagcaaaaggaagaaacaaaaaacagatcgatcccacgagcaagactaagtgtaaagtggttcccacaagagccatatggatatggtccttcaacttttaaagcccattacttcagtggtcgacccgacattacgccacgagtagtcacgcacgcacgactccgttcacgtgacattcacgttgatatttccccctctactctcttctgcttggttgatctaaaaaacatgaagagaccaacctaatttcatattaatatatgatatagacttcatactcaacagtcactttcgtaatccaaatccatatcttacgaaattagttcttaataaaggttgtggattaagttataatattgtgttaagagttaagacacagcatataaccttgtaccaacagtgctttattcttaaatggaaacaaaacatatgtcaatgtcaagcatacagctaaaatatcattatctaatattaagagtaaaacaagataattaaaaattgaaacaacaccatatttttatagctttacttatcgtatttttctagtcttcatggtaattgtgttgctttattttgtttataaatgaatttggttcgaccagatagtctaatatcagtttttaaacactggttttaataaaatcatatgtcggcaattcaacctgttacgttgtatgattgtatcctagtcaaataggggaggaggtactagtcgtttcaattagtttacgtaatcaatccaaagaaactataagctataaagatcctcaatttgttggttacaataaaaacaacagttgtcaaaatttatgtttataaaaagtaataactatgttccttcccatatagagcaaagtacctcaggataggcaaaccgtacttaatagcccttattcataatttgatccaactcttccccacaaaattgcaactgatgaagtcaatacttgtatagtgagtcaagctataaatgtctagtgatagttttgtctcttaaaaggttaacaaaagttatgacaagctgaaaaatcagagtttgctaggagtattacttacagttatcagtttaagtatcacatttatagtattgtatacaatgattcttaaattccaccttttccgtgcgaaaccaaattttctattggaaacatagaatgtaaacaaaaatatgggacgttgtccgttccaacattaaccaaacttgtctattactaatattcgtgttggtttgatgttggatgtctaaattcgttgaatcatgtgtctcttgacgaaatatgcatcttcttatttcttagtatagatgcactttatcattcttttagtacatgcttaatttttttttttaaaatatgttgattgtcatattgccaaaagtatgaattaaagacgcacatctaacacaagttagcagccgtaaatccttccataaatttattttgcaagttttgctcattatataatgagcggaatttatgatataatcgtttgtaataatgttatgttttgatcaaaatttgaaattaaaagtaggtgagaacttgttatacagtgtagataaggtggatcttgaatataaaaataaaatttataagatgtatttaaagcagaaaagcataaaactttagataaaataatgtaaaaatgtgttagcatcaatgttgggatattggccgacccgaacttaatcaatgtcggaagccattacttctctcccaaaagacctttttccttcggagaactaggaacttcctcactacctttcgcttaacgtgaaagccataaatttcatatattcataaaaatcagaaaatctaaaactgtttagtatcacctgtttttggtatagactattggttttgtgttacttcctaaactatatgatttcgtacttcattggatcttatagagatgaatattcgtaaaaagataagttatctggtgaaacgttacttcagtcatgttgggtctagatttacatactactatgaaacattttaagataataattatcctagccaactatatgttctatattatgggccaagaagatatagaactaaaagttcagaatttaacgatataaattactagtatattctaatacttgaatgattactgttttagttgtttagaataaatagtagcgtgttggttaagataccatctatccacatctatatttgtgtgggttacataaaatgtacataatattatatacatatatatgtatatttttgataaagccatatattactccttgacctctgcccccatttccttttactataaataggaatactcatgatcctctaattcagcaatcaacaccaacgaacacaaccttttccaaagccaataataaaagaacaaaagcttttagtttcatcaaagacgaagctgccttagaa

SEQ ID NO: 327 - DNA, 3000 bp, Arabidopsis thaliana
ccaacgcgcaaaatatgatcaccaaggttgtcgtccttagatctacaacgcacaccaaggactttattgttcagctcatttttgaccaagagtgtacttattccgaatgtatttctgatgcatacactaagaagaatcacgaagataaagagattcttcatattgtttttttttttctttttggaactaacaatatgatcaaatctctctggtctttcatttttttctccatgatgggtacttatatacatctttgattctgtttatagacattgatattttttaatatcttttttgataattagacattgatattttacaacaacaaaattaaaataggacaaatcggttaccaaacttgttcttatcttattttaattagttaaaacattttggtagtcttctttttaagtgcgtttcaagttgatctttatatagacaacagaaacttagtaatgatatttatgtacatttctaaattgattttatgtttttaaaatcaaatttgaataattgaatattttcttccttaatatcttcatttcagtacatttgtttattcttttccaatattttatgttttcataagttttcttatattgatcttttatttttcagtagaatatatatatgactttaatcacacagcttttttagtaaaaattattaaggtttattgtaatcgtatataaatactatgttcaattttgatcgaaccaaacacgaattaagactaaaagctttggatttggaaaattgcaaaatatgtttttagatattcacttaaaataaaataaaataaaatatttagtctagtagtcaaaatattaattggttatataaaaggtttcattataatttcaaatttagttttaattagcttaaaaatttcactaattaatcaaagataagttgaaaatacattttgaaaaaaatataatctagtgacataaacatataatagttactaatatcacaaaaagatatatattctaattaataatccatgatttagaacatattttgttttctcataaaatatcttagaaaataatatttgaaaaaataagtagccatcaagaaaaaggaacaaacataagtaaaaagaggaaacgatagaagtttcatgttggagagaaagaggagggagatggtgatgaatttttccgttcgaaactacgacgacctaattaaaatatgacgtatatatagccaacattcatatgtaatgacatattttcgagtctccgatatattacattctgtgttattaatttatcctagatatatagtactatacattgacatcaaaccaagaatactaattataacataaaattaagagcaactggttatgattggtttacatccagatgtacataaattcaggagtcctctggttaaaggacaagtagattcctttttcaccggcgaaccatgtagcatttgcattatttttctgagaggtgttcatacttgacttgtaagctataaacgaacggtgatgcgcccaatggtaaccctggtgtagattgcatataaattgtgtctcatggaagaaagcatctttgaaacgccaagtttgtggtggatcattgtgacgcaagtacatggtcttaaaatcgtcgtcccctgaataacaatggagcttcagggttgcgttttttggtaacctgtttactatcattaatacgtttctcccatgcgtatctccaatgtaaaacactaaaacaatgagaacaattgtgagacgtttcattttgtttttctggggatgttaattagattgtttttatttttttgtttatttatttatttataaagattgcgattttgatgtatttatatatacaaatttgatcagtatatgttttttgaggttgtgctttaaattctgtcttctctttattttttgaggttatgcgttaaaattaggaatggctcgagtggtcatcatgtagaaatggcttgagtggttaaaattagaagtggctcgagtgttctacttgcaatttttgtggaggaattgttaataaatatttcaaccataaacttaataaaatggttaaaaaaatttcgtctattcctaggtttatagtaacctttcttttcgtactttggcgaaacattccctttgttatatcattatatcttttaattctaacattcttttcttcgtttttagttggatgctttattaatagatgaattttaaaaatatcatagatttaatcactgatgcccaatacaaatttgtcaacatgatatagtttgccaaacctaaagaagaaacatagataaaggttacattagaaggggggcactatagtggcactagttcactaggtcattcctttcacccaagttcgaaacctcaccttttaagcggttacatattcatctctcaagtgggcctcgagattaaaattaaaaaggttacgttgatattgatgggtttagacattaatagtaggtattaattcgataagttatgaaaagacagtaaaactggttaagtagccgacttaatttggccttttgtatctccacttggttggttggttggttggttggtcagcaaaacacctaagtgagagctctctagaatattcttaagtgataagaattgaagaaggcggcattacttacttactagaaagaaatgagaacaagtcttcttagccgacttccacaaacacgtgtaccaagtcaaaccaaatgtgcccaaaccaaacttagatactttcacttttcatctctagtccacacaacattatatataattaaaataaatatatcaaattaaagtgattatcgacttcttcactcttcttcaactctttctcatctctcgacacgcaacttccttcctcttcagactcctctgactttactatatataacacacacactttcatttcttgtttcttcaaatcaaatcttttcatttacaattatctttcttctcaatttagaacttagtagctagtcttcaagata

SEQ ID NO: 328 - DNA, 3000 bp, Arabidopsis thaliana
atctcattttcgaggcaataaaaaaaccatttgggggtttagggttttaaaacatagcgagatgaagaagtcacgacattgtcaaattaccttcttcgaccttcttcttcacgtgattttcacgagcttgctccacatagctacccattgacgacggaccttcgagcttttccggccttctccgatcaattcgatcaaaagggcaaaggggactagaaatgggttcagggcaaagggtaaatccgtcatttaccccaaggaaacttaacttatattgccattttgcccccttaatatttttgtattatatgaatgaccttattaacttatgattcgtcacatttcacccacttcaatttaaaattatggacgagaattaagtcctttgacggtcaacagattagcacgtgtcgtattttaattgggtcgttgcccctctctctctctttactcttttcccatttaatggtcacgagaccgtctcccccaaatttctcacttcccctaatttcgcttcgaattcaaaagccctaattcgaaaattcccatttctcaaggtacggttccgatcttccttgctcatacttcgacaatgttttttctgcttctcgttttctgcgtttattgttgatatgttgttgatcttcgcgttttggtcatcacttcaagatctgtaggattcaaagttcgttctatcgattttggatagatctagcagtgtaaatcgtttgtcaaagttttttattctttgggtgcgtggattaattttgttagagatgattgttatcgttgctcttgaatgcaagattgttgcagcattactgagttctatttcgtgctctttgtttattgctgctgcttgatattttcttgttgaaaacaggtttttaaaagagtattgcaaagatgtcttctgattcgtcccgggaagagaatgtgtacttggccaagttagccgagcaagctgagcgttacgaggaaatggttgagttcatggagaaagttgcaaagaccgtggagaccgaggaacttactgttgaagagaggaatctcttgtctgttgcttacaagaacgtgattggtgctaggagagcttcttggaggattatctcttccattgagcagaaggaagatagcaggggcaacagtgatcatgtttcgattatcaaggattacagaggcaagattgaaactgagctcagcaagatttgtgatggcattttgaaccttcttgaggctcatctcattcctgctgcttctttggctgagtccaaagttttttacctgaagatgaagggagattatcatcggtaccttgctgaattcaagactggtgctgagaggaaagaagctgctgagagcactcttgttgcctacaagtctgctcaggttatcatcttgtttcttcttcttaaccatatagagtgctaagataacatgttgtctcatgctattggtgtttgtgtttttatgtaggatattgctcttgctgatctggctcccactcacccaatcagactggggcttgctcttaacttctctgttttctactatgagattctcaactcatctgatcgtgcgtgtagtctcgcaaagcaggtctgtgttactttttcatttatgctatgctttctgtcattaactaacaaacctatattccaactgttttgcttgattaaacttagcacataagaggttctttttttctatctatcgttcataatgtggcaaaaacgtgttacgtagttaacttgttacacttccatgtgggtagactttccatatgttctagtaatggtttgtagattgcttaccatagcctgaccgatagggttgtagttaattttgatgatgggcagaattgggaaactagatcctgtgaatggttccatacactagtgaaatttggacaaccttcacattcggattctagtttgattcaagtaccttttgtttagttactaatatgatttttcatggtggtaggcttttgatgaggcaatctcggagctagacacattgggagaggaatcatacaaggacagtacattgatcatgcagcttctccgtgacaatctcaccctctggacttctgacctcaatgtacttgtctctctttacactcatcattgttagcaatatcttagtgattgcatcatgcagttaagattcttgttggttttcgcataacatttgtgtctaatatctaatctccaggacgaagctggtgatgatatcaaggaagccccgaaagaggtgcagaaagttgatgaacaagcccaaccaccaccttcgcagtgataaaatcagatccatggaatgatttgcagacaaaaaaatatatggcttggttctgtgtttttaaacagaaaaaaaccttgtagtttccttaaacatgggctgtagtttccttaaacatggatttgtagtagtaattgtagctgcatgatttggttatcgatggttaaaactctttgtgtgcttctcacatgttttggttgttgtcgttgttgccggtttcactattagactgcattgcattacatggtccggtctaaaagttgaaaacttgcttccttctctgattggggtttagttgtcttttagattatgcttctctaggtggaatgttccccaaatggaattggttaagactcaagagagttgttcaatgaaacgaaatagaaatggaatttcacaactttaaacgaaagataaagcctctttcggtttggaacaactgttaggtaacacatataatggaattacaaatcataaatcctccatgaccataagctaaaaagttggattaattaataaatgacatgggaatgggaggtaacattaactggtccaaaataaataattaatgtaatgacacattcacataataatatctcgaattgaaatcccaccgagagtgccctgcttttccactgagtttcttcatatatatctctttctctctcatttgtaattgtatctctcacttttgtttca

SEQ ID NO: 329 - DNA, 3000 bp, Arabidopsis thaliana
aggaaataacaaatctaaggtatatctttattgatcaaatctactatagttttggtttttatagataaaaataatttattaatttaagattttgtcacgcatcatttttataaagatatcttttcaaaaatatctatctaatattactaacccattatattactattacatatcagtgaaaacatttaaccatagaaagacaaaattcatttgtggtctagatagaacaacatgttgatgacgattaaatatattagatggaattgactcaaaaaaaaaatcattacctaaaacatcggcaaaacattgttttcatgcaactcagcaaaattaatttgaagtttttttatccaccatgatatcaatatcggcctatctcaagatttacatataatctttaattagattaacggattggttagattatctaacgtagataatgtttgattgtatggatgttttgaagaccattaatgccaactagcttaagttttttgggaaaatggataagccattagcctttttgtttgtttgttcatagagcagaccattagccatttatgatattataagatggaaatatctcaagtggcctaaaaatgaagaaaaacatcatacacatactgtaaagaacaaaaaaaaaaggaaatatcaaagttggccacacaaaaagagaggccatggaaatatcacacagacaaaaaatatctgtttgaaaaaagatggagcatgttcagtgtaagttaggccaaaatatctttagattttattcctcaagccaaaagtcattgatccactacacttcaacaccggtgcgtagagcatcatccaaccaattaatcaaacattttctttttcttatatatcgttgagttattagtcaattgtggttattacgctcgtctgtatatcataggttcgagttcaagtaatttaaagtttgggcgacaaaacaaaaatagtaaaaaatttgtttcaaagtatcatgttgtgtagttgaattttaattttgccccacatattatctttttgattaataaaataaatatactttcaaatagttgtaatttatcaaataagtattgatcatagaacagtgattacttttaaaaacagttgctaatgttttaaaaatgtaattctttctcgaatttcgtactttctattacatattataaaaaaataacttattatttagataccacagtaaagttgttatccgtaaaaattatttgacattatatatcgttatcatcattatacaaattttttttgataattcagatgattttaatggttttttatgtccaaagagtaatcttcaagcccgaaaaaactatgttaaaattcgaacttcggtgaccaatattactgaaatccaaatgacgaataattattttctggtttattattggacgaatgcgacttaattattttgtctattttatatcatttctattagcaacatcataataaaatttctaatatatgctgtcaattatgtgaccagcaacaatatagtaaaacaatgttaattaaacccatctaacaacaataaaaatttgtcactgacatagttttcctatatagcacttatttttcttttgtcaataaaacacgccggcctaaacctatttctcagtttaacgcatgaagtgctagtacaaggaactaaaccacctggcttattattaaccattttcttcatttgtttgattgatcattacactaattgtccttttttattacctagtagtttactaagtttgattaagagaagaaaaccatagggtccagtcaataaaaaagaaagtcatagcgtaggacaagactcttgttacaagagagcgagtaggagagatatattacactcgcgggcgcgtaaagagacaaggaaaaaagaagatatttagtctctgacagtgacagctaccatttaaaggtgaaagactgtgtcagataataaccatacacgtgtcatattcctatccaccaaagaaccacgaggtttttaaacaagtgtctctaatctaatcccacccaacaacaaaatatctagccgcggaaaattactttaaaattcatcaccctttgtccctactcttgactcgtgcatgttccatttgatttattccaccacgcaaccaaaatagtagcaatagaaaaaaccaaaatgttgataaaaatttggtaaactatgaatctctatgatcgatattcatttgtttgattgttccatttcttttctaatgcaaatcaatattaaagtgttcttatttcgtgactaaaatatatggctggccgaaaaaatataaaataatatatgacatttgctattagttagcaccagtgatcatttggtgtaagcaaatgttttttgtgccaaaaaataatattgaaatatatgtataattaattcattaacaaaaagttcttatttgttatttcagaaaataaattataccatgtgtccttgattttcttatgtgaaaaaaaattgaaatatccttattgtttttaaaataaacaaattgcaaacctatgtaccaaacagaaaataatacaattgtttttggataaatttgtatagatactttttcccactagcattagatattttttgggtttggtattatcccaaaagtcacgagtgggatttttataggtactcaaaagctaaaatgtctgaacaataatataaaatacattttaaaataaaagtaaaatttagaagcatcaaataagtaatagtttcaatgtttagtgttgatctcttattaaaagaaaaataaacaagaaattcactaaatatttctccatcacaaatacataaacatcaattgcaataaatattttggtaaagtataataaaaaattaaatccaactttaaatatgaaccacatagaaaaaccaaaggctagccaccacaccaattttttcttaaaagaaggttatttggcgtattggatctcttttgtctcgtatacagtattttgctg

SEQ ID NO: 330 - DNA, 3000 bp, Arabidopsis thaliana
gataatagttgtttatgtatgattgatcaattaaacttataattttccattggaataatattttcttgacctttaaatttggaatgtagatttatatggaaaaagtagataatcatttttgtgacgctaattaaatatgttgtcccataacgacagaaaaaaaaaaatgaaacaaaaatagagaccagattggttcaagaaaacgacacacagtttaggatgctaaaaaagctttgttagtaccatatgattgttatattgtttattggttccttaataatgtatttagacgtcaaaaaatgtttttgtattgatatgtgacctcataactggttagctgcttagggccattagattagagttttgattgtttcaaatgtcaaatcttacagtccgtcaaattttatttgatgtgaagtaagtgagttgataaatgggactactttctccagttggctagggtcgactgctaataacatttctccaaggaattaatctcaacgggcttgttgctcaggcaacaatttataggaatagagattgaacgaaataattaacagattacacaacaatgtttcctctactttaagcaagcaatcttcaaggctatattgatcgactgattcgagacgcaatcgtcttgtcaagaagaaccacaaaaactatgatgatatgtaatgcaaacttgactcgtctttgagtaacacttcttcatctagtccaatcgtcgcagggtttcttttaatttatttatttattatcttctcttttggtaagaaagagcttctttaatttggttaaactttttttttttggttaagtacaaaacttctcattccttaataaaattgatatctatattataaaatatcaaattttgtaaaacaaaaataattaagagtagtgtttcacaacaacaacaaattaaaaagactactatataaattaaaaagactacttggctttctagaaattattaaatataaatttttatattaaatctctgatttgctatatcatttattaaaagtgtgaactttattttgtttcattgtaacaagtaacaacatgactttctagaatctagtgagtgagtcgttgattcattctacaaaccagttaatgcaccgcgtaaattcttttcacgtgcatggtgcagtgcatgaagatggatcaaattaaatacgaaaccaaacataattcaatagtatatcatcttttaaaatttgtatgattaataatctctgtcaataaaaggccgcatgcattgacttgactctttcagtcttgtcttgcttactaattaaaccctccataatgcatcaacctaatcataaccgaaaattttctgagttgtatttggttagactttaatgctttactatcattttagttacgtttgtgtttacctcgcaaaaaatcttctagaaggataatataatactacaatacaatgttggcattatccattactgagcggtgtgaaattggttttgattgtttaacatatgagttaaaatttgttcgcaatattggcaaattagcatcggatatgctattgtataagaaaacgcttatttttggagtgcgcgtctacctgtaactgtataaactacgtaacgaacctttgaacgcagagtgaatgtgagtctctgtgacacgacttaaagcttaatcagaagcagattattggaccttatggagactttatcaagattagctaatgaaggttactatatatgaaactttgaagtaattgtttgcagccttttgggatcaataaaccataaaagcattggttttgttttctctatctatatccaattccggaaagtagaaaactggattagtaaaaatcatattcacacattgcgaagaaaaactatgtgcgcgcggatacgttgggaaaatctgcgcatggtttaaagttttgctttcagtcaattataattcgttttttatactccctctgttccaagatacttgatattttgggtttttgcacaagaattaagaaaagtaacttttatatttttaattattcttttagttagtttaataatattaattttacttctctcatttcattattggttacaaacaaaaataataatgatagtttttcaaaacatcaattttggtggaacaaataaaaaaactcaaaatatcaaataacttgaaacagagggagtagttaattaaaaaaagatatttcacactttgacttggcgaagcctcataacaatgaagttatgtatgaactatatatgaagttagaaacaatggaaaacagcttgtaaatattcattgttgtatatatgtttttttgggtcaatttggtgcatgaacaaaaataaaaacgtagatgaaaaccggatattttggtgttaacatttgcatttgaacttcgtgaaagacggataaaagctcatttttgttctttattatatggctgctattagtacacagagttgaactttagaatactaaaaatctcgacatcttttattttatttttgtcaagcatcgacatcttttctgttcaagaaaacgaccgcaatagtcgaataatataactcttggactagttaatatatatttgcgatagattttcgatctcacttatatcttataaccaagagacaaaaacaatattgcagtcaagtacaaaacgaaaacaatcacaatgtcgactatagatgagtcggtcattcgatccaacggctctgagtccacgaaacacgcaaccaagtggtgctctcttttacaccaaatcatattataaaaaacttaaaagaaagagaggatggttcgttggctccttcttgttccttaattaattcaaattatattcatcacctccattgaataagtccatttcacgacaaagtcaccaatgcttcttttacatgtatatatacttctttccactccctcttctctactcaaatcaaatcttcttccttctctgttttcttaagctttttgaaaattttatca

SEQ ID NO: 331 - DNA, 3000 bp, Arabidopsis thaliana
gctctaaataaagaaaatatttattggatgttacacatattttgaactgcataaagccatttttatcgattttgccactattaattaagatgtcaaatatagattccttctttatcggtgttccatcaaataatctctcagtttttctttctctctctctttctcttgccaaaactcaaaaaaccaattccccattgaatcaaacgaactcaaacttttgtcagtttattactaaacatataggaaaagttgaactatcttgcctaatccattttttacaatagaggaagatcaacattttggcaaaattcttatgcaaaaaaataagaacaaagtgtttgtcattcttttagttgattagtttttttttaactttgaacccattgaggtttgtaataaagatgttgtcatttcgaatgccgtctatcggaagccaacctacggcatttgctgcaaaaataacggacaatccaaagaccgtggcacaactcaagtcggctgcatcgccttcacctcatagtaccgtgacgtgcggttaccaagctcatgtggcagggttctttcgaaacgtcaccgttttatggtccaagaatctcatgaatcattccctcaccgtaatggtgtcgagtttagacaatgacatgaattattgttgtaagattgatctcgtgaagccatggcagttttggagcaaaagagggtcaaagtcattcgacgtagagggaaactttgtggaggtcttttgggatcttcgatcagcaaaattggctggaaacggtagccccgaacccgtgtcagactattacgtggcagtagtttctgatgaagaggttgttttattgttgggagatttaaagcaaaaggcttataagcggaccaagtcaagaccggcattggtggaagggttcatatactttaaaaaagaaagcatatttgggaagaaaacgttttcgactcgggcaaggtttgacgaacaaagaaaggaacatgaagtggtggtggagagctctaatggagcagcggagccagagatgtggataagcgttgatgggatcgtggttgtgaacgtgaagaatctacaatggaaatttaggggaaaccaaatggtgatggtggatagaacaccggtaatggtctactatgatgttcatgattggttgtttgcaagttcggagactgcagcgagttcagggttgtttttgtttaagcctgttccggttggagcgatggtagatgagagctttagcgatgcggaggaaggagatagcggaggagggagtagtcctttgagtcgttataattcagcatcaagtggttttggaccattgcatgacttttgtttgtttctttatgcttggaaacttgaatgaagactattaatatcatagtgtgtgtgtttttatttaaatctcttttggtgattaagttggaatagaattagaaattaacaatttagtctaccttagtttggtcccaaataccaactaaacgattgctcaagagttaggacaatcagatatttgcaaacaaaaagtttgtattagtttaaccatactttttgttaatcgaataaccataagaaaatttggtaagtttcttatggatatgagttagttttctttagctaggccattatatatataagtctatttatttacaaattcaattaaaaacaattagcttatttagttatcaattaaagctgttttttattttaaaaaattagcctattaaggttttgactttttaaaaaaaatacatgaagcaaaaaaagaatgaaaagtctttaaaaaatgaaatacttgacactagcattgtgactatctagtgtacatagtttcaaattaaaagttttcaactcaaattaatgtactaatattttgtcaaattgaataatataagtaagagtggacaccgacctgcgcgtgtcagtgttacagatacacaaatatctttttttgtgtagacgtttccaatttgccagatattatatttgatctttctctttcttttcacctacaaaaataatatctccttttttaggcaagatattttgttcattcatgtgcgtctctcaaattaagatattttggttttttgtaaagtcaaagcaaagactattgttgtgattgggcttttaagccttaaagcatctaaaagaagacgcttttgagaatccagaatcggaaaagttccacttgtgccttgtagatcgcgagtacggctctttgtctacacgcgagcgcgtgacttcatactcataaaaatatctttagggtccttagaaaatgggttcttttgaactttttacccaatgtttctagaattatcagcttatgtcacatgcctctgcctacatgtccctttgcagacacaacccacccattgtctatccatctgtttctccttttacccttcttcacacgcagctaaagaagaaatttgtggaatcatcgcttattcgtttcaaaagtcattcatttttggtgtctctgcttcagaagatacttgacgatctctcctacgtgagctctttaaaacccttgtcttgttattttagtgagggttgctttgattctcaatcctttttgactgatcttgaaatggatcttctttcacttctctcggatttgtaataagaaatctataattttttagctcacttctctgattggtacatgttgatctgaaatttgaagtctttctgcgatgttaattggtttctctgatgtctcttttgattggtctttgatttagaacagtctcatccataggaagttacaatctttgaggaagagatgtttaaaaagattggacttttatctaattctggacttgctttcgataccaagtttcaagcttttgttagttgtttaatgtattgtggtaagtttttttccttctaagattatgatataagggactaaccaaaatggtttgattctttgttagtgaaaggagcttgctttcttcagtgtgacggttgagattggttgaaag

SEQ ID NO: 332 - DNA, 3000 bp, Arabidopsis thaliana
tttgattctggagagactgcaatcatacgtttccaatatgaacgtcttagaagaatttgtagtcggtgtcttcgtttcactcatcaacggaatcattgtccttacatggttcctcttcctgcaccaagaaatgatggtagaggtcaagacatggcagaaaggacaagagcggctttacatgaggagctttgcaggtcggatatgaattctcaatcacaactgtcagatgactcctttcctgctcctataactccacctccaaggactgctacccctcctttgaattctgcagagcttgcagctgcaagactttacctgttcccttcaagaacagctactcctcagaacttgatggttgaaaaacctcaaatggcaactcttacaccacgtttcaggtcagaatctcatctctctccaccaattgcagatgaagtcacttctagattttcaagaattttagagattggtgaatcatcaagaagagctgagattggggaaggttccaggccaactgaagaaggtgactcatctaaacgcaagaccacacaagttgaacagccagaggcagttcgaaggaatcaaaagcagaaagtaacagagcttaaagaaggagggattctgaaacctccaaagaagcggtaaccactctaattattctgtcatcactttttggcgttaaacaccttttggcaatggtatgttagctcagtgaagcaagggtttgaataattggtatgctcaggattttattggagtatttgcatacctaatggttagtgtgcagcaattccgtttgaatagactggagattcaagcagaaatggaatctgaagatgtagctgcaaccttttgggttatgttcaatggagtcttcattcactttagaagatccatgttttaacaatgtatgctttaacttgttagttaagtttgtaagtggaagtttccacagttgtatcttttgcaacacttgatctatataaaaagtatcactttttgtgaaaaaaaaaaaaaatatatttaatttggatcggtcactagcatttttttgccgataatgtaagaggtttgttatggttgttaagcttaaaagatggtggttccgccttatagaagtgaaaggttttagattttagatcgatgatgaaactcacgatgacttttttgcgtctagcaagtctggatggtggtgtgatcgtggtgatttggttgttgggtttagggattttttttactgggcagctattttaggttatttggagaagtgatcatttatcggtttgagactatgtggaggcaaaattggagtcgccagatacctttgatcgacggcgtgagttgaatgcgaatgaatctggtctagttttccaacactaatcttactccttgtgttttctgaacttcaaagatttaacaaattaacagaagtggatgaatgaaactgaaaacccgaatcgaaaccaacccaaaaaaccggtttgggtcaagtaggatataactaatttacctattggatcctatgtaattgtaatcttgggtatcaggtcgcttcgggtattacccgatacccgaacgagtaacccgattacccaaaattagctacacttatatggatagaagctttacttacatcggaaaatcggacaatattttggaaaatctgataatatttcggataactaggtaaaaatttcggataatcggatataatatcagttaatcaagtaaaacttcgagtaatcaggtacaatcagatagaaaaacatttgaactgaaaagtaccgagtttataggttatgaaatcttaaattcgacccaaatccgaatcgataccaaacccgttttttatatatatcttattggatcctaaatttctttacttaaaaaaaccaaatccgacatgcgtatccaaatgtcgagcacctagtgtaggagttagattctcatccaatgtttcttattttggtggtaattgttttaatgaagttaattctacccttagctcttctccgcctatgtttgtaggtcctctcgaccagcacttctccgacttacccggtgtccttggcatttgtatccatcttgcgtttctgtatattattcgggcctatgcatggtgacaaaaaatcttgtatcttttttcttttcattgttgttcgtcaacaagaatttttgaagtaagtaattaagacttttgtgattaaccaacattcgtgaaatgctcctcgtaaaacttttatttccagcattttgtttatactcttgtgggggccggagtttttcaaagcttgaccatgaatttattgaacatcttctaatctgatttatttggcaagttgttctatataacttgcatgcaggaaattcaaactttcattgttcaaaataggcaagttggtctatataaacaacaaagaaacaaaaatgaagtaacttaaattgaataaaagtttcaaacaattaaacgaaaaaaaacataagtttcaaatattgcggccaaatcatataatccacagtgtgcccaaacgagaatccaaggcagcaataccatctaacataggcacatagtcaagtggacacatacacattcgtgcatccaccttttccaaaatataactaaactttacccttaaaagtaagaaaaaagtgtcaatttttctttcaaatatctctcagaaaaacatttttaatttgtgtctgggatatgaagaagcctggaaatagacaatagctatgatgatggaccctcgcaagaaaaagacatagccacaaatccttcattatcttaaaataataaatgatagagtagtccacttgccacactccaaagcaacaatagaactaaacaagtcaaaacaattgaaaaggatccttcctctctccaacccaagaagctagctacgaaacctctcaatcccacttttatatataacctccaatctcaaaaaccaaaatccataatcaaaaccacaaagaagactccaacataattcatcatct

SEQ ID NO: 333 - DNA, 3000 bp, Arabidopsis thaliana
ttgaggttgatcacagactatacaatcagaatcagaatctgaatcagaatccgtatccgagtctgaatctgatccagaacaaattatatcactactagacgaatcatcatcggaatacggaatcacaaccaaatccttatgaagaaactgtttaagagctttgctgaaatctaaaagagatttaaagtaaagaagatgagatctcgctaagtgataacgagcatctctagctgctttgatcaattccttcctctccttacatagattcaacaatggagtattactatctcccttggaagcaacgatacccattaaaccctcttgaatgatctctcgaaatcggttaaaccctaatttgatttcctcgctttaacaattgatatttcgtggattgattgagttgttgtaccttttgacgacatcactaaaaagtaaaaaccttgtttggcagaagtacgacttgatgatgaaccctaattagaaacaaattcgatttattttgtagagcgacgctgaagttaaaccgtgtttgatttccttttttttggttaaggttagtatataattttaagaaaaggaattagatgaaaaggaaatttgtagctaaatggaaaaaatctcacagtaaataagaagattaaaaacaataagttacatgtaattaatgtatgggggcacgttatataattgatattaagatcagctaatgatggagtgtgtaaattaaatttcattgacactacaaatatattttcgcaattccttaccaaaaaacaaatatatatgaagttattttcttacagtacaaagttgatgttttgatacttgtatcttgtagtatcgagatcttgaattttcattatggaatttggttgaccagtttgacaaataaaatgatgcacctctcatagagtcatcggtatccctgataaaaagaatcaaacgtggaatggtccgaatgaataaaatcttagtgtacatatatataaatcatataatttgatagaatttatgttgaaaatgtaaataatatgtatttttatcaacaaaaaaatttaaaattattataattgggttgatcacccatactgaacaaatttaacaatttctattgtaaatttgtaatccacttctctttttaataaatctttaaagaaacttgcaaaagaaaacataaatggaaaagaactaacaaaaaataaggagtaattcgtaagatagatgtgtattgattcgaggcttcttctaagttgttctaaagttgtcatccacaaacatttaaaagtaaaaaaacaaaaaaccataaaactcaaaacacctccactcatcagcgcttttttaatgcatgtggctctcaaatgaagacatctcgtgttcctttgattcttcacaattcacacttcaccctttacaccactaatcttcgccacgtaaaaatttctcaagcatgttacgtaggcccaactttaccattttttttgttcttatatatattttacgtattatttgttatcctaaaatgactttcaatccatctttgctagtcttaatctcgatttcgtgatacaaattaattcctttgatcaaatgaatacaaataatcaaattaattcatctttgatcatagatgaattagtttgttctatggatcaaaaccacagatcaaactctatcatacaaaaatcgttgtgattttcttttaaaaactcacaactgtaaacatttgaaatgacaaaaaatatttgtctaactacaagcttcttagctatctatctatcctgttttttagataaaaattcgtaatacctttcatttttttaatccaggtttaataatttttcaaatatatattctatattctttttaattaccattagcaaataacaagtaatatatcgaattgccaatgatgtgaagtaaaaatgtaaaattagtggttggatttatttatttatttttatttagagaaaaagacatttaactcgaattatgtaaaatatggaacgctaaaagtggttgataaaatcataaaattaggttcttctcctagtaaccatgttgattcatggacaccaaaatttccgaacccaaaatgcgatattaaaaatccgatcatcattattatcctaccgtaataccaacgatataaatgatatttaattcacttttcattttcgaaaacaaaacgcttggaccggaacgagagaggaatactgaaaaaagtaaaaaatgaaagaaaaaagagtggacccattagacgtgtattgaggaccagacaaatcccaggtgcggatcacgtggttctaagtctattacagaacctgattcgtccacgtaggataactcagaatcttccctctcctctatacgaggctaatatctcgccacgtcattaactaaaaatctaaccgcataaaaatatctgatgaaacataaaacgaataatatctcgacacgtaagacttcgcccataggagagccttgtcccagtacatggtttcaggaccaagtaaataacaacatttcctttaatttttattattattatcatctctcctaaatttaagaattcgagaataatactcagccgcggaaaccttaatcaatttcaaacacagatttagaactactaatacaaaattatccacaaattatccaccataaaaattaaagtttgaacgaatcctttaatcttattctaatttaaaattaggaagcttctttgcatttcattaaaaaattacgtgaaaaatcgtttcgttaatatcaaaaagacgacaatatcctcgaaaagaattaaatcacataaaagtcgccacgaaattctcattttacaattctctattacgctgtctcttattcgtgtccgcagaagaaacgagagaagagagagaagcaaaagaccttaccaagaatatttataacacacaaacatctagagacagagatagacatagagagagagcttgtggttgtggttgtgcgagataatatctagag

SEQ ID NO: 334 - DNA, 3000 bp, Arabidopsis thaliana
gcatgctcatcatattatttatcaacgatacattctttctttatattaatattggctagcttaaaacttataatacttgttgagagttacatattagttatcctagagaaacaactcaccaaatgtgcctttggattatacattctctttatctattttatacatttttcgaaattggaattattatggagacattagacatatatgaatattttgagttatacttattttatattttttataagtagagttacacttatttaacaggttagcattacgagttcaaaaagaagaatttagttttgctgaaataaaagcttgtgtttatgtctttaatagctcgcacaccacctaaatgggatttaaacttagccatacaacgatgataacacttacaaaagatcatttatatatacgagacggatcccgccagtagtatcgggaggaacgcgagaactgtttatgacattgcgacctacacttgtttaaacatcagataacatatgattaatagtctaaactcaacggtttattgaaacagttagtgaaataggccgaatttaacgtgaaaaatacgtaacagaacgttgattaatagttatatatatgtggccgacgcaaagcatgacgttttctgcacgagctgtcacgcaaggtgacgacgtttttaatcaaagtgtttagggactataaacgtataaattaatctgttcgatgttaatagttctgatgccaagatgcggttcggttttctaaaccggatcgaaagtgataatttttaaaaacttaaaccctaactggctaactctttcactgacgacatacataacacatttcactgactaaacttattttgattagtgtaataaaagagtaaagaactccagtattggcgtattgcttacactgattctgtcatctccacattatttatgtcaagcggatatgttgggttcctattatttcccttttatctagtttataaaactgttatgttattattgttatgatgtactatataacatcctcgtttgcggtctcaaaaaaaaaaaagacaacatcctcgattgtggtggaatctgttccgatatattattggttaatttttgattgaggcgaactaattatgtaataagtactcttcttttctaaactttgaatcatatatagtcaaatattgaaaataataaaaaagaagatacagaaaatttattcgcacatgattttaaaattgacgataaaatcttgagatggggtcaaaatacagtgcattttagtgcccaaaacagcaaaacaattttgcgtggatctcatgtcggaagataacaataaagataaatatcattggctatgtaatatatatagatagaactgtgatataaaaatctatcgcaatatttctattgtacaaatatgtttcctctaactctttcgtatacgtggatagataaggattttgatagtgttgccttatatcttttcttttcactctctttttaagtaccaaccgttgcgtttactttgttcttccttttggaactagaccctaggtcaaacgggcctgtgtaaatttttggattatacagtttttagccggtaaacgaaaaagaatgtattttactacctaagaagaacatatcagaaagcaaacattataaaagaaaatatcgtataagtatacttcatcatttaagattattgattagtaaaatatatatcagaaagcaaacattatatcagaaagcaaacattagaaagatttaatattttgagagaaaagataaattataaggtatgatcttatgagaattgaatctcgaacacgttgctttataacacactacaaaatgtatatttttattgataatatattaccgaatcttcattactaaaaccgcaaaaagaaatcttaagtaaagctataccttatgatttctcgaagtcaaagtttctgtaattagaaagaaaaatcaaatttgctttcatgccgaactgtagataaagatttctaaatcatgccgaccatactgtccattttttcaatattatttaaaattccatgaatatccatcctcaaagggccctgtctagaatacgatacaactagtatataataagtctacaactacgtaacggagttatcattctaaaagataatacatatttgacaaaataaatagaaaattaaagtttttaaaaaaatatttgtaaaatttatgaacatagtggtcatttggtcgagaaagaagattttttttttcttttaagatgaaaaaattgtatgggtcattaatatcatcttattatttaaagatgtacaagctttagcttatctcatttaaggatgtacaagttatatgcatacacacgcaaaaataaaaataaatcaaagtttaatatttagtttggtgagaagaatttgagtcattgacataataaattttgaaatcatgtttgaaaaggagactataagctagtatcggtccctagacgaaatgatgcctcaagaacatacgaagtttattaattaaactttatttctattcattaacaaataaaacagccaaaacaaaactaattcaataccgacatgatagataaaatccattcaaaacctcaaacaaatttgttttggagttaacagaaataaaatattttgaatttgtagatactcctacatgaaagaaaaatgaattacgatatcaaggaccagcctaattattttattttgttagcctaattttcatttctacaaaacatatctccatcacgattttattaaaacaaatcccataattcgattttattatgtggatgtcatgtttacacgtgtcatattacaattcgttaaaatacagtgtctcttctctgtccgactgggcatgacagatcatccaagcaaatcaaatacccaactctcacacgttctcaaacaaaaacttcaaagagagagagagagagagttttgtgaactcaagaaaataaaaaaagttatagtta

SEQ ID NO: 335 - DNA, 3000 bp, Arabidopsis thaliana
ttactttaacttaagtaattacttgtagagccatatgaggagggcgatccccaatgctccgaggctaccagaagctaggaaccccgttgccaagaaactcgatgtgattaccgccggtacgagaatcggactaagaaccaccaaaaccggtatcataacggttagagccacggccgtaccggcaaaggttaaaccggtgaggatcatgaaggatacgacggctataccggcataaataggagctttgtctttcgtgccaaagaaatgcatttggcagtaatagaaattttgttacaacgtaatctgattgtgtattaaagagtgggtccagtggtgagatcgacgtgtacgacacatgactgaagagagtatttgtcctgtccatgcatgcaactgacacctttgttagtgaagttgctctacctcacgccaagttacttcgctttttttgttcacatcttttttgtatgtattaaaaaatttcacatttttttggcctcgttcgtttacttttcttctttcgtaaacacacacaaatttgaaaaaaggaactcaactattatatatcaatttgaaaaaatcgacacaatatgtgaaatgaaagatatgaactagagataattagcaggcaaaataaaatctgataagtattgcaagtttgcgacgaacaaagagtgaatcaaaagactgcaattaaacaaaaaccacagtatctgcaggctatatgaaactacaacttcaaaatgttaccggataaattagtttcaattttcgacgatatgtagcatagtgtggttaattatattgacgaaacctttgtattgattgcaattataagtgtaaattttggcaagttgatgtgtaagctccttcgtggatccaacaaataattaacagctatggccgatggcgttgatgagtggtcgcttctttagtcatagcggtcagacaattcaacttcattttattttatttatttattttgccatcattcaacttcatttcttggatgaaacaaattcaacattcaaaatttttttttttttaatatatatataaattatagatattccattatactttagtttccattgaaaccactatttgatggatgattcttcatttattcttgtcgaccaaattaaacttctaatggttttaggtctgattagtatttctttcaaaaacaattttcttttaagagaaaaggtcatattactaaggaatagcaaagaactaaaactaataaaacaactagctctaagcgtttttttgtgcatcactataacaagagacgtgcacttttaattagtagtttagtactatataaaaccctattacttgtgtggatttcgaccaacctataacaaacaacgtttcggtataattttaagaagaatatatcacaacaacaatgtcatcattatattttgctatcctttgcctcttcatgattttcctcgttcctttacatgaatgtaagtacatacatttttgcatgcatataactcatcatctaccatcgcaattatagttagttttaactcctattttctcttttgttatagttggaaacgcacaaggttctgaggcggagctgcaattagatccatcaatgtgtctgcgtgtcgaatgtgcaaaacacagaaatcaaaaatggtgtttttgctgtgccggactaccgaggacctgttttcttgataaacgaggctgtacgtctgtctgcaagcgcgaatctccttcaatggcttaagaaacttgaagaacccatatctacaatttactaattacgtttaaatttctcttgatatatgaataaatataagtttatggaaaggaaacaattacgattatgcttatcgtaatttaacatatttttttttatttttttttatgtttatggtaattgtgttaccattgcaatttgcatgtctacgaattcgtcttgcattggtaatccaatattccatgtgatgcttttctttctaactgaaggtattcgtgaaaacgaattcaagattgtgggagataattagggtttcgtcaaaagcatgaattaggaaaatttgggattgattttttgaatttgggaaaagtcctaattttaattcgatcaaagcttaaatgatgtcgttttgggctgactaacgaagtcgttaacaggtgccaacgagtgttaaaaatctgttatcgcttgataactctttggttttttagtctaatcaacacattctcatgtttcaaacagttaatcaacatattgttcatgttaaaaaattaacacatgtgaaattgatatataaaaatatcatatattttcaaaagttggatcattaaataaaatttttccctatttttgaaataattctaaaacagtattaaagatatttcctgaaattgtttgcatgtgatcggttttggaccgaaactaaaaaacttagaaactatattaactttgagttgtcgagatgaagatgtgaaatagaaatataggatcaatggttagaattttggcaaatgtatgaaggtgtgtttgattgaatattccaagtcctttgccttttggaattggcataactactacaacaaagttttgataggttttccgaattctttaaactccttaaatttttaatacatctcaatcaaactccacttatactaaaaataatccatattgcatttttaaaaattctaaaagaagaatcacatgataacttgataagcacttttaaatgatagatgtccacgtagaggaataagacaaaaagacaaaataaagaaaaaggacgaaatctaaagagagaaaataagtaacaagtccaagaaaaggtagtatgatctttctcggtccgatcctcgaaactccctcgaaggctcgaaccctctctttgtttttttaccactatataagaaagtccgattcctcgtcactcttattcccacttccacacatacacatatacaacagagcaagagagtcaatcaagtagagtgaag

SEQ ID NO: 336 - DNA, 3000 bp, Arabidopsis thaliana
tactttagctatatatattaagaaaaaaaaaactaggttgtcaagaccagctcacaattatgttttgaaaacaaatcaagatcagatatgctccaactagaccgtactaagtaaaatctgcaaaatctgtcttgttacttgtcactaattgaactggcttgcatgactacaaacgttgagcttgcattttataaaactgtatgagaccaatcagcaagatctactagctaggattggattaggttggattattccatcatgacatttctaatcacaatcatcaccctcgtgtgaccaatggataaataaccactaattcaaatctaaaacttgataaaggctcgttttaaaatacaactctataaaagatgtacataaatttaaaagaaaagcttaatcatatataatttatacccctatatacgtaaaataaaatagcaacaagattgagacaatgatcttgaaatcgctgagagtcgagacacatgtcttggaacatggaaaagaggttgacccaagtcgctgaaatgtttgaccatatgacattgaattgtgggaaatactggaaactttgaatcaaattaagttaataaattgtactataacaaaactaatacgtgtaagttttttataagtaacaaactgtactataaattaaattatggatttaacgaaacaattaatgttgctccttagggcatcttgtattagtccagttttgtgttctttattattaagtttaagattccttatattaaaggcacgttagagactaatgactgtgacttcgatcaacaactatcaaacgaccagtcgttggatggagcgaccaaatcatagtgactaccaaactaacaaagtagcaactgtcaaacgaataacagaacaattcgttgatcgcactcgctggtcgcaattactagtcactggcgattagtttagaactatatatgttcatgaatgagtgtggaatttgtttttaaaaattttgttaatttttgtgagtgtggaattttttcttccacagtttggtaatctagatcgtgatttgctagtgtatttcatacacattgttgtgagcttacgatacatagtctttagactttagcatatttaagaattgagaactatgttataatgtttaagtagattttaaagcaaattttgtttagtttgcttcgctgggacattttaaaaggagataaagttttaccgatgccaagtttttatcgttttacagttttttttttgtcaaacaactgatattaagttaacttgcgattataacaacttgaagctttgccacataactcacttgttgaaagtttaaaatagaaaaataaaggaaggggaaacatgaaagtaataagagagtagattaacatcatggatgataaccggaaactccttcgagaggattccataagcgatcggtttgaagacgatcgtcgactcttggtcttcaaataaagacgagagtgctggtagttcttctgccatcgaaggctgacgaacaacaataaagcttgatgccactagggttaagcgtttagaaacattttccctaaaggagaggattgatgaaaaaagtctctccttcgaagaggaggaaagaagaattggtctctcaatatatgaggaagaacatctcatatatgaggaaagtttctccaaaaaaggagaaaaatctctccaaattgtaggaaagtaacaaagaagactcgttaaaatcacaaagataaccggtaaaagtaatagaagcaaagagcaaacgttaccatgacatgactcatggtccaaatataatgggtctcgaggtacaaaggaagccataaacattggcccagctcaaaaatcatgacggcacgattggtgagcatagcagcaaacaagccatcgccggaaaagataggcaagaaggcggagccaggcatggaggtggtgggcacatcttcaatctctgggatactcatcggagaaggaggtaaaaggaccaaaaaagtgacagctatagatctcggaggaatatgggtgatgggtggtggtggcaatgaatctggcagatccggtgggtctggaggctccggtggacgagtcaagttggacggctccagaaaaaagtgacaaaggaaagttagagaactacaacttggacaggagaaaagacatcacagtagagcaaaacaccatggaacaacaattgaaacaagagaacagatctcatcggcggcaattattatatttcgagtcacttcttcagataataaaataaaaatattaactttgaaagcgatgtataatactttttctcccattctggttatattttatttcgcttctcttcatttttttttacatatttgtattatttcataaccattaatttttttgtattattaaaaaattgtaccattttagattaccactcatgcttgtagacttgtagttaaaaaaaatctccatttatttaacaaatttacaattaataaaaatagtacgagattgataatatttttgagttattgagaggttgataagaaaaagaaatatttataggggctaagaatctttattaacggcataatttagtctattactgtcatgacacgtggatttagatctttttgaatactattttttcttatatacatttacagcaaatcatttctctaacattttagggttttacgaaaaaaaaaccttcaccgtctctgctccgcgacgccgccttcgctttctcaaactccgatataatccttctcaggtaagcaatcttcttcgattctcattccttcgttctctaaggttttgtatcaatcgtagaaagttttaaactcgattttaatcggaatcaattttgtttcatcgagtttgttgttcgccgtggtgtcgaaaaccctaatttccgattcaaatctctagaaattagtgttgcgttatcaaatttgtgatcttgtattgattattcattcttttgattttgttgtgtgttacagagat

SEQ ID NO: 337 - DNA, 3000 bp, Arabidopsis thaliana
ttaatgacttgtgattagttttatattctatacactaaatatttcatattattttcctactttcaggaaagtgatgatgaaaaacctcctacgaagaaggctaaagtttcatcaaaaacttctaaacaagaaagctctagtgatgaatctagtgatgaatctgataaggaggagagtaaagatgagaaagtgacaccaaagaaaaaggtaccaataatgttacttctcagatttctctatagagtgtttataaataatatatgttctaaccttttaatgaaaccaggattctgatgttgaaatggtggatgcagagcagaaatctaatgcaaagcaggtaaaaactccatacagtaaaattttgtcaagaattttattcctttagttatgattattatttggttaacacgttttatgtaataacgtttttatgtggttataacgtttaaatgttatgtgtttatatattacagccgaagacacctactaatcagactcagggaggatcaaagacgctatttgctggaaatctttcctatcaaattgcgagatctgacatgtaagtataatgacattttttcataacatttttctggttcttcctataaaatgttggtggtatgatatttataacccaaaatacagagagaatttcttcaaagaagctggtgaagttgtcgatgttagactttcttcatttgatgatgggagttttaagggatatgggcatattgaatttgcttctccagaagaagctcagaaggtaagttcatattgggtttttttggtatcatggaagtggtattgaaattacgatgatgattggattcatttttggatgttttgaatgtaggcattggaaatgaacggtaaattgttactaggccgcgatgttcgtcttgatcttgctaacgagaggggtactccacgaaacaggtacgtttcttactttgccatatgagcatgatgggattatgtatgtttttgtttataggctaatatctggtttgttggactatatgcagcaatcctggtcgcaaaggagaaggaagccaaagtcgaacgatttacgttagaggattcagttcttctcttggcgaagatgaagtaaaattcttgtcctagacttttcttaaaccaatattaacatgttacaaaagctatttgtgtaaaactctgatgcaaaccacttttgtgatcatgatcagatcaagaaagagttgagaagtcattttagcaagtgtggagaggtgacaagggttcatgttccaacagatcgtgagactggtgcttccaggggctttgcttacatagatttgacgagtggattcgatgaggcgttgcaactgagcggaagtgaaattggaggagggaacatacatgtggaagagtctagaccaagagatagtgatgagggccgttcctcaaacagagcacctgctagaggagcacctcgtggccgtcactcagatagagcacctcgtggaggacgtttctcggatagagcaccacgtggacgtcactcagatagaggagcacctcgtggccgtttcagtacgcgtggaagaggacccagcaaaccaagtgtaatggaatcatccaaaggtttgtttcttcttcttctcctctcctcttccccttttttgttgttgtgcattgtagaattagtgttgttttaaaacttgtgtgtttgtatggtcttgcagggacgaagacggtctttaatgatgaagagtagaagaaagctgtttttggttctatcttatagtagtagagcgtttttggcctagtttcttttgttttctgttgagaaaagcattaagctttatactcttcttaagattctttttgttggtttttcttaaaacttattaagagcactttactttgctgctcaaaattttggaataaatccttttgacttcattagtggttcattggcattgctatcagcccttctcagaataaagcttagacaatttaaaatctctaattatcattctctgttgcccatgccaaaagtttttgagtaacattttctagacagatcacgtgttatgaatctggctaagacaattctcagtttctaaaaaaaaatattttttagagttttcacacgttaagaattttattaatgtttaattataaatatactattttgcattaaacaatttccataattctaacccaatagtaattcaataaatataaaattttcaatcaatatttcttgaaaataacaatatcttgttattatttattgaaaaaaatacattgaaaacctaaaaattatatctttataaaacaattttttttctttctagaaaatacactaagaaaaagctgaggcttcacaaccgaattgttaaccatcttgattttgggagtagtttgtgaattgtaagccaaaagaagaattgactaatgtatttttaaaataaaaataatagacggataaaactgaaattatgtgcattttagttaatcacatactcattttttttttaacacaagtacatacttatttatataaaaaaaattgccgatattatacgaattactgaaattaggtgtataatgaaataaatgttaaaaaataaaaaaataaataaaaggttacgaattacacaacttcaaaggctcgttaaaccctaaaccttgtctccgcgccgcgttatcactcttacgtttctctctctctctcaacttcttccacagcaaatttcttcgattctctgagctctctcccatccttttcaagtggcttcgtttctaaaagtaagtttttttaatctatgggttctcttcaagtggttgttccttttcgaatctctgtaccctagatgaaatcgagtacagctttaattactctgtttttctttgggattgctctgtttcccttctcttagaggtgtataattactctcaaatttgttgtttttttcattcataaattcattaatattgctgcagaattgattggttgaagaaagtggaaac

SEQ ID NO: 338 - DNA, 3000 bp, Arabidopsis thaliana
atgaaatattcacgtagtcatatacatgatacggtgatcacaaatcgaattgaatcgtgtagttaattgtcgtattatataacaagtaaggaattattacaaatgtactaggtaatcacccgcgctacgttgcggtattttcaaatttttttatcgtttaatttaaatataatttttaattatctaatcatttacttatataataagtaattattcttagtattaaaatatattttttttaacaacattctcaacaatgcattatacacacaattcctaaacaatgttcgtcttaaactaattaaatagagggtaatattgggattctcgaaacctaagaatttgatgattaaacttcttacatactcttcaccctcgacgatttattatatatatatatatatatatatatatatatataataatatgcaaactattcaaactattaattaatccatgactactatacactcataatttgagttaagattacagaaaaaaatcttttgagtatgagaaaaccaatcaaattattttattgaaaaacatttaataacaaaataaatttagtattagtataattaaatatgtaaaattaaataataaatacatcattaatctataaattaaaagttgaagagcttacattaattattcagtggacacatggcaaatgttaaagtgatgatgtgtcaatcatatggagagagttggccaactttcatatatatgattcttaaacctgtaaaagttcagttcacccgacgaaccaacttccaagtagtagtccaaatcatagattcttttgaggttttaaatgtaccctcacgtcagaatctacttaagtctttcccctttttctgtctctctttcaccttttcttctccatcgatcttacctccacggaacttcttatttaaatcaaaaaaattcagaatcttttaatctcacgcaggcaaatgtctcgtaatttaatctatagaagaaacagagctctctgttttgttttaatcttgttctgcttcccttaccggtttggcgctagaaacacgccggaggcggaacaatccacagcaaaagcaactcaaataatacacgtcagcaattccacgtggcatgatttctctcgtcttgtagatgtccaaataggtagccacgtcagcggcgtatcagagctcaaaagatacctccaccgattcggttacgtcaatgatggctccgaaatattttccgacgtgttcgatggtcctctggaatcggcaatctctctgtatcaagaaaatctcggtttaccaataaccggaagactcgacacgagtacagttactctcatgtcgttaccgcgatgtggcgttagcgatacgcacatgaccatcaacaacgatttcctccacacaacggcgcattatacgtatttcaacggtaaaccgaaatggaaccgtgatacgctaacctacgctatctccaaaactcacaaactcgattacttgacgtcagaagacgtcaaaaccgttttccggcgagctttttcacagtggtcaagcgtgattccggtgagtttcgaggaagtcgacgatttcacgacggctgatttaaagatcggattctacgctggtgatcacggtgacgggcttccgtttgacggtgtacttggaactttagcacacgcttttgcgccggagaacgggaggcttcacctcgacgcggcggagacgtggatcgtcgacgatgacttgaaaggatcttcagaggtggccgttgacttggagtctgtggcgactcacgagatcggtcacttgttgggattaggacatagctcgcaggagtcggcggttatgtatccgagtctccgaccgaggaccaagaaagttgaccttacggttgatgacgtggcaggtgtacttaagctatatggtccgaatcctaaactacggttggattcactaacgcagtcggaagattctattaaaaacggcaccgtatcacatagattcttgtcggggaattttatcggttatgttctgttggttgttggtttgattcttttcctataggtttataggcataaaaaatactgtttttattcatttatttttaattaaatgtacatatatttttcaactatgtaaatgtaaatatatagttgaacaaaaaaagatgtacatatatagttaggcttataattaggtttatggtcttgatgatagcttcctctaagggattattattctttgattcattactttttgagtttgtgtatatcattatctcaaaaaattgaaagatattgatgtttatggaactatacatgattggtcccacccctaatggcactaatgactaattcataggtgatagattactttatatatgtgctccaagtaaatactgtttttttcccaatccaaactagattgaggaaaaaatgtagataaaatatctgatctactttcttaagatcctaccttcatttctttttcatagtaatcttttctccatatttacaagctatatacattagtttcttgttcagacaaaaaagaaagaatataattccattagaaaaaaaaattcattaaacagaatcttattttagttaagaaaacagaaaactgttttaagtttttttggctaaatatgtacacattatacaaaccttttttgaaagaaaataacatcttggtgttttgtatcatcattttttctttaacatcattatacaaagttacaacaacttgaaaaaattaattatataagcccattaaatcttgtatcataagcccagcccaaagttataaacttttcaaaatgcaaggagctaaaaaacaagttggttttgttggtttcaaatcaaaccaaaccgtttttttaagattacgaatcgaatggtttatttttgctaaatcggttcggttttttctccagacctattagtaaacctcttgcttcgattaggcggtcgtctctctgaaattttctgaaacctcttaaaccctagca

SEQ ID NO: 339 - DNA, 3000 bp, Arabidopsis thaliana
gcatcgcattctcttcttcttttgcttttgttgagttgcgtaatgacttttacgtgtatccctcgtgcgtgtgtacgaatgcgaccctttacctttctttgtctcttgagaagttggatattcacttttacattatttaaacactatatcagtaacataaatgaagtatagaaaaacctatcaaacatattttgaatgtttttattctaatgctttgaaaaagaaaaagaaaaaatatatatatcataatacttaagtactatggaatacgtaatatacaattatttttgtatgtgaatatccaatttcatttgcgatgttaatatacattttttagattttatcatcaatcatggcaaaatatagtcttttgaatagatgagcatatccttagtagaagccactcgaagcaatcatggatgtcttccaatgaccatctaacatttaagtcattattggaaacttaaagaagttgtataacaaaatacttagatgttattatgaggatgctcttaaattagtatatgtcaagtgttgttattgagaatatagcaattacttctctctctattatgctcatgttggattgtgaatccttaagaaaaattcttaagactgatatttataagaaaaaaaaactgaacatggttcagataccgggtttcaaaacattatggtgttaagtccatacaaatgtacttgttttaaagtagaaaacatgtgtggtgttggtcaagtttttctattacatcctatcaaagcatgtacacaattttaggtagacgtaataatgttgttagtattctctttacggaagatgtgtgtgatgcgtcctatcacatattgtcattgcaaagtgtgttagctcattatgcacatggtggtttagctctttatgtagattgttaggatctggtttgaaaaaataaataatagttacttaacattcatacccaaaaaaataataaagaatagttgataatatttcatgaaaatcgatttgttttggtggacatacatcgtcgtctctactctattgtctcgatcgcaagtaatatgacaaataaagcagcagccctagcaataaaacatgtgactactaaaataggaggatttatctttacttgacgaactataaattaaatatctactcttttaccttgactttgaaaattactttttaagattgccttttacaattatgtggaatagcggcacacatttacgtaaatttaacttcaatttaaaacaatgatttattcattttcatcatacaaacttttcagcacattttctcctttttaatataattttatatattatagatagagatatagatcaaacaatgtatgactttaaacttagattgtaaattcttcttactatgctcgaaaatttcatctacgtatatagatctattgtaaacctaagtttaaaacggaaatcagttattgatagtaatctagtaagtttaatcaactatgcgttataacataatgaaatcatatatacgagcttagatatctaattcagttaatcaacaagtcaactaaacaaggcttcacttttccacacctctacagatcgaaattattatatattcgaattatgtaactaatgtaagtcttgcaacgtgtggatagatacaaaatggatatgtccataggtatacatattaaaaatataactagaaatggtatattactaacaaaattttacccccaaaggtggccatccactagtagccacatgcttatctagtagacattgaacatgataaaaagtgccaaataagtggaataatcaatgggaatcttcattcctataaacaaaaacattttcaagcctatgacatagctagctactctacaacatgtatatgccaattgggatataaatgtattaaagcataaccattaatttgacaaatagaaataaatagttcagaatgtataagttgagaaaagttataatgattggtagggagagactcaaaaagaaaaaaggatgggtaatgggacctattttccccaacatcccacatgcacacttccctctccattctctcacatttatttctttcattctaatttatccattccgtgtgtaacatattcactaataatctcatctcactaactcattcattgattgtgatatgtttatctagaattagtgttttaacactgtgtctacatatgatttccttttcattgtatgtgaacatgttaactcactaatcattttgtattttcgagttaacatgagtctccacttcggtagactaaagtaaagataggtttgagtataataaagtttaaaatttgctttaaaatcaatatttataaataagtttttatcataagtgatttttgtatgttatattggaccttgtataaacagactacagaagaaaattatttatgagaacttgtaatgttagagtggacctcgtataaactaattatgtgggcttttaccataaactatttatgaaaattattatggcccacaccactataactaaagcccacatatttagcagcccagtttcattgtaagagacatgttcgctctggaactagaattttctggtttttgggtatttgttttcttatgtgtagagaaatgatggtaacgattaaatgttgtgtattacaatttacaatggtaagacgattaatatatttacacacaattttgttgttgctgtaacacgttagtgtgtgtgatgatagaatttcataaagctttaactacgaggggcaaaatgttaattctaaatagttgacagcagaaaaagatatgtatacataatataaggattaaaacgtaaataataataaataaggcgagttaaattaaaaccctgttaaaaccctagcttgaaacacatgtataaaaacacttgcgagcgcagcttcatcgccatcgccattctctctctcatcaaaagcttttctccttgattttcgcattctttagagtcttaacgcaaag

SEQ ID NO: 340 - DNA, 3000 bp, Arabidopsis thaliana
gtttttgcattttcatgtgtatccgcgacaagcacaccaatgacctgaaatacaagattagcttagaaataagggaacgaaagcagtacatgaaaactttttaaacttatttgacgtaacaaaatcaatacatgctcctttacttttctggtatcacttcttctaagatacagataaactaaaagttccccattgaggtttattttcttacttgtcccacacacgtgaccacgtctgtagcaaataattcttcgtcggcaacaattggtccaatcatattattcccgggaacatctttggcaagaaacagaccaacaaaaccagatgaagatttggctgccgaatcatcaactgaaaggatgcgggcatgtggaactttacttagcactaaagcagcatgcaaggtacaaggcggcaatggggtatcatcagtatattctgcttcccctgtgacctagatgaatatacaagagtgttgagatacactctatggaccttcggcgagccaacagatggaccaaaatacctgcattcttgccgaaagatggacctctggcaagccaacagatgtaccctgttttactgtctcatagtcttgttttccaattctagagaaccgaggaacaagttgcacagctgacatatgcgagggtggaaaggtctctatagtgggatttacattatttacatgatgagtaacccataagaaaaatttaaagaagaagcttagggttagagatttgcgaaactccaccattcccccaggagcaccttccttaatcaagacatcactctgtatgaccttaagtgcgtcttgcagaagacatttattccaattcttaccaattagaagttcctcagtgtttcttgcacgcaacgaaagaggagccacaccaccataaacaatagatgcatcagaaacaaacaattgttgccctttctcttcaagaaacacacgcattccaccattgacaatagctatatcatcatccctgcgatgggcctgcttaaattctttcacatactctaaaggccttgtccatggaaggaataccgacaacaagatctcgttgcttcccatatccactttacgatagccaaggaagaaatcttttgcaggtatagatctaacatctccattgcagttgattatccgaaactctgctcttgaagccatccaaagaggatttaaatcagatattggactagctgtacagatgtttccaccaatgcaagcaacatttcttatttgtgtcccagcaaaccacttcagctgttcgataaaagccttgcatgctgatgtttcatgtgcaggacgctcctttactaccttcctgaataacctcaggagttcagaaagtctcaaagctgaaccaacctctatcccattgtcattgacattcaatgcgttgagttctgggacttgagcagcagagattagcaccggatactgtaacctctttagtctcatttcgattcccacctccgtgttaccaaccagtagttttgcatcaggaaaatttgctttgagttcaagcaagttctgaagacttacgggtctataccaggtaatcccctcatttccccctaactttaagggagctaacttcctcagcagaagttcagggggaaaaataagctccttatctgtatacttagctccatctatatcactataagagattgactgaaatctatcttcattacaagtagctgcttcacttgttgtttttgatccacaagaacaaggtttgccagtagatggacaaatatttgaaccgtcctgaaggctaagtgaagataaaccactgtatagagcatcatcagattttgcaaaaacccgaaacgcatcaatgatgggtctataaccagtacaacgacacaaatttcctgcaaggcattcttcaatctcctcctcagaaggtgagtttttacttgacctcaacaaggcatacatcgacatgacaaaaccgggagtacaaaacccacattgagaaccatgcgaagatgccaatgactcctgagagaaatagggagaattaggatcgcagaaatgagaaaaaaaaaatctggaagaagtaaaaccccacctgaagagggtgcaagccaagtttccgatgaccaactccttcaatggatattacatgcatcccttctacagagtagagaggtgctaggcaagcgttgacagcataatgcctgcaataaaagtttccggtatgaacagtataagaaggcctaaacttaagcaaagcagatgcaacctatgagagaaaaagatacgcacacacatgtctttgactctcggtcataactagacaccatcacggtgcaagacccacaaccaccttcgccgcatccgagctttgtcccggtcaatcctaaatctaaaggaaacaaaaaacgttttcaagaatcccaccacacaacaacctaaccctctaaattttgctgcattgtacaatttgtggcttctctactctatctaaacttagattagatataagcatttgaagaaatcaataatatagagttaaaagcacctctgagatattcgagaagcgtcatgtgagctaatccatcaggcaaaactctacgaacaccattaacgtacattattgcctccatgaactcgttctgctccatcttcactgaacccagacgaataactgttatccaataatggcaaatatccaataatggcaaaaatccaataattgcaaaatcttctctttttaaaatgttttttttttgttttcatttttcgacaaaaaatagaaaagcccaattattaagcccataaagaagaatgtagcccaaaataagcccaatattggagtcatcaatcaggtctgggacattgaaaaaactcagtaacagtctaacagaggaaacgcggcggaggaggttttacgactattttcccttcacttcttcatcttcttcctgcgccgcttttcaaacctattcgaccagacaaactcggaaatttcatattcc

SEQ ID NO: 341 - DNA, 3000 bp, Arabidopsis thaliana
gaacgaggttgttttctctcttcattttattcttcttctacttagccgaaaaagaatgaaacttggtggtctatatgtatgctctttggtgtggcatgagaccctttggtaattggagaagtcgtgatattgttaattacgaacttgttgaatttattccaaagtatataatatttaaggcagcaacttgtttttttttacatattctaatttaaccaacaattaaagtcaaccgttgcaaaggaggagacttcgtctcatgcataattaacaataacataagaatcattgaccggattccatgtgaccactcaaaagagcaagacactcataaacgttctcagctcgtaaatgagacctgtcctcagcaaagaaatggcacactttgtcactcatctcaatccaactgcagcccggtttcttcctcaatcccatttctttcatttttaatctgactcgtcttgctgcatcccatgactcaccagaagcatacaaattgaacaagaccatgtaggttgatgcatcatctggataattctcaacaagcaatcttgcgattctatctcccaatgaatgttccaggtgcaagcaacaagcagagaagagagtactgagaagctctgcattgtcacttgtctctggtgtttgttgaataatttcataagcttcaagcaaccgacctgctcggccaagaatgtcaatcatgcacgagtaatgttcaataataggctcgattccgtactttgatctcatttgactgaaaaatttgagaccctcatcaattagcccagcatgaccacaagctgacaatacagcaagaagagtaaccccatcaggttttagaccaaacttctgcatttcatcaaactggtaaagtgcttctctgggttgaccatgagatccatacgcagagatcattaccgtccatgatacaacatccttctttggtatactgttgaaaatcctaaaagcctctttttcattgccgcatttagaatacatgtcaagaagcgcactcaaaagcaactcgtctgtttcgagcctgctctcactaatggacaaatgaatctgtttgcctttctctaacgcagccagttgcgaacaagcaggtaaaacacttgtgaaagttaccacgtctggcttcactccaacactcaccatttggtcatacacttcaacagccttaaaccaattacctacactgatataactagaaatcatgacattccatgactcagcaacgtccttctgtgtctttgaaaagacggtttcagccaaatttgcttcaccacacttgaagtatagatcaatcaaggaacagttcacatagatatctgcatttacaacgcttctaatcacataaccgtgtataaattttccatgtaggagattccgtgagcgagagcaagccatcaaaatgctggtcaaggttgtctgactcggtcgagttccttctatgatcattctattcaaaatctcaacacatgacttactgtctcctttagcgacataacctttgatcatagaattccaagcaaccaaactctttctaggcattttctgaaaaacctccctagccacctccaagcagtcacatttcccatacatatcaacaagggcagagtttacatactcatctaactcaaaccctttcttcacacattttctatgtatctccttccctctctccaaccacaacagccttgaacacgccgatatagccaccgtcaacgaaactgaatttggttcaaagccagaactttccattcttccaaacaactccaaagccttctctgcctctccactttgataaaaacacgaaataaccgtgttccaagatgctacatctctctcaggcatttcatcgaacacttgtagtgaattctcaaacaagttaaactttgcatacataccaaccaaagaactcgccacaaccacatcacaaacatacccactcttcaccacaagagtatgaatcatcctaccaagaaactctctacccaacgcaccataagccttaatcacattcggaaaagtaaacgaatcagggacacaaattgagcaattcaacaacctcttgaaaacctcaagagtgtcatgaaacattgagttctttgaataaccagacattaaagagttccatatgtaaacatccgatcgtatatcgaagttctcgaagacgtgtctcgctgagcaatggtctttacaagtaaagtagacattgatgagacttttgcataaaactacgtctcttcgtaaccccaacgtgagtattctctgatgcacaagcttgattcttcttagagacttggtgctattggtacactctcgcaataaagacaacaactttgaagattccatttcaagttcacatttttttttgtcgtgagagattgaaatgtgatcagtcgctgctttagctaaattataaaggaaagacatgattcaaactacgacgtcgtttatactaatgggccaaacttaattaggcccaaaatgatttatttttctaaattagcgatgcgttttaaaaccctaggttacaaaaacgcgccgttagcaataaaaacgcagcgttttgagaatctctgaaccttcttcaacaactataaaaaccatcttaaaccctagcagaatcgcggctcctgattttagctctctctaaagctgtagttgtgcgttaaccctctaaggtactgaatctctctcgccctctctttcttcgttgttatggcaaataagcttccaaaattctaagactttgacaaagtatagttctgttctttgtcggattttcaagaatttgaacagagtatctgccttaactattattctgatttgtaaacttcgaaacagggaaaaagttttaccttgaatattgtttcgtactagcttaatggctttagctcgtaaaacactaacttgcaagtttggtgactttgagttgattcaagggtttctcttaatcttgttttttcttcttttcaggagcttgtaaaa

SEQ ID NO: 342 - DNA, 3000 bp, Arabidopsis thaliana
tactttggttgcctcacgttctgacctaattttctcccaggtgggcttaggcccattctccttacctttgaggcccatttgcagaataggtgttccaaaacgtcttcttcagaagcccaggtctgacccaaactttctcttgctctcctttaatataattttgagtagattcatgtcatctattgattgtggacgtcaattagagcatactctctcattattgctatgttggttcaagatttacttgagaaccctgccactagaaacacctatatccttcttccatggttgtaagagtttggaaaagagcggcattatgatctcgcctccaaagagcggtgattaccgcattcttttcaaattgtcatctctgctgcacctatccattgaatttattcagtcgcttttgcttcttagcatcatcagagatctacctaaggattctacaagagtaatgaagatgggcattatgatcccgttaatatcgagcggtgattacccattcttctccaaactcttttctcccagcccactgtgtttggaactcaagatcatacccgattttatctgtatctctcaggatattaaccctcttgtctcaacgccctctatgcgtttcgcgtcgccgaaccatgaggcaaaggacttcttctcaacgtcactttatcttggtttgatagtgaatatttcatatttccccgaagtgttcgtggaagtgtctttgacacactttgaagtcgtgtgtggtatgtggcttgtttgcctctgtctccgactctcattggtctatcttctcaagttatctctctttgttgctagcttatgtttttttaagatctttgtaacctgtttcatctttgagaactttgtaaacttgcccttatgggatttgatggaatgaatacaaatcttgtttgataaaaaaaaaaaaaagaactaattatacaaaaattataggtatattcttaattttaatgttttcttggtatataaattaatataatcctagtatagttttttgattccggtaaaaactttttttgattccgccactaaaaaaacacataaaaaaatacacctcgtgagtggtcttctttactcaaagatcatgttcaaatttggaaagtatttgtgtaggaagactaactgctaacaaaagaaaaaataaattcaagggaaattataatggatatgctcagaagaacaagaaattaagaatctatgcttgaagtttctttatttagttctctctcatctcactcaacttaataccaaaaatatcctccactcgtgttaacaataaaattatcagataagcggtttagaaaactatcaatgatgattgtgagaaatgaggaggtaaaagtgacaccgtcaatgatgatttcatgtcacgtgtggtggactggtggggtaatggtgataccaacatcgatgatttcacaagcagtgatggcgttggtcggaaaattacgtcagatggagatagtgatggaatggtggattggtggtggtgatgatgataccaacatcgatgatttcacaagcagtggtggcgttaggtcggaaaactatgtcagattgagatggagatggaagagttaatgattgaagattagacactggcggcgagaaaacataattatgttgttttctagatttaccttgttggtgaaaagaattagaataaagcatgtttttgttattgttatcatattaacattgttatacacattaatataaatattatctatatatcacatttattagcataaatattatcaatgataatataaatattatcataccaattataaagttatcgcgatacaatatgatttcacatcatatatttataaattgcttgatatatattgtgttatcgtgttaaacgaatagataatcatataacttatcatatattcttacttacatatttgatggaaatctatgtaaaacaaaacgaaaaacttcgataactaatttgttatatatagaagaacatttttatcaacttacataaattatgaagagaaagctaataatataaaaactatgcatagatttttaattttgaagtcttctgaacataaatttttaattcaccctaaattcaaaagtttcaaacaagataacttgtgttggtcaacactaatgtactctagagccaagaaatgttttcaattcatgtatttgtttgacgatcgacctaattccaaaatcaaatagatcaattacttaagatagtgaccctttttcccttaaataaatgaaaaatattcaaagaatacacgatttacgacacgattttcatacgcaaaacacacttggaagtttggactatccatcaacttgagactttccctttttgtagtctgtccaattgacttaaatattattactgttggaattataatattgatcgaaattttagccacttaccattacctccacaatatctaatttaactttaaaaaaaaaagtttattgacacaattaacttatagtactactgttgaatttttttttattttttattttttaaattagagttactttcttagaaaaatgttatttttttacaaaaataaactcattcaattatatatataagaaaatatacattcgttttagatatgaattggatcttcccaataatagagatacagttaatccaagatgaacaacatttatgaaatttgaattttcctacaacatacatatattcagtgtatataacccaataatgacaaatactaaaatagaaaaaacgaataacaataaataaaagaattaaacccagtagagagtggccaacttggaccgagtcaagttacgttacatagtcactcaaaccccaccacttgacgcgtttctcgtccccacttcttcttcctcgcaactctttcactctgtttcacacacacattctcacatatatataacacaaactaactctaatcaccaaatcataaaccaaagcttctaaattcagtttca

SEQ ID NO: 343 - DNA, 3000 bp, Arabidopsis thaliana
atgaataaaggttcccaaaaaatgtgatatattaaaagagagagagaatagaagatgcctcatttgtggttgaatacttacatgttggggaaaatgagatccaccaccagcatttccagtagccaaattagtgtacggaacaaacttggaaggtgaagatgcatgagacaagaaagggctgattccaatttctggttgaacagcttctggaactggtaacataggagtattgcttggcacataacccatattcgcaacaacaggcgtcataccggcatgagctgatgtaagacgttttgcaagagatggggaaaaagtctttgctcctggattcagtttaaactcctgaattcaaaaacgagtaacaaataaagtaagatgaaacaatgcacaagtcatcaagctgccataaccaagaaacgagcatctcaaactaacatatattctgaatatgagaaaccaatacgaattctttatcaccttagccttcttgtcagggtctgttgcctgcgtaggtggtaagctatttgtagataccaccaaaaccagactcacttctgagttttcatccacagtagtgctctgtgatgaagaattttcagttgacgagggtctctccgtagcatcgtgaaaaccattactagaaggttccggcattttctcttgttctatcggctttacacgttcagacatgttgtccactgtcattataacacgtgatgagacacatgtcaggaaacattttcttgtcaaaaaggaagcagaaaagagttcatcatggttctgtaagtaaaataaaaaagtttttcccaaaaaggaactcacagctacaacttgagcttctggcttcaacctgcaataggtaaatataataataagcagctgctgagcaatatcttgaaaaacagaatgaaccaattatgtgcaagactaacgttatcctcctgatgaacatcagtaatttttttgctattcttcaaaatgcggactcctgcctgtctgtcagcaaaagaatatacaagaatcagagagttacctactgagcacagagaggtttattgtagccagaaaactagatagctaaaactgatatataagtagaagtttggttacatattggcaaatattaagacggagataaagattttaacaggacactaattatataccaaaaacagtatacttatgatccataccgttgatggttcagtgagctaggatgatatttgttctgcaaaagaggaaattggaaaaggaatcaagagagtgaaaaccaagaaagggactcagactgtgaaagctgaattaaacaacatgacaagatgttaactaatgactctaggcaaggcatctattttaaagtcaacccattacagaaaccgaaaaccaagtcatctactttaatgtcaacccattacatcctactaaatggaggctggctttaacttccatcttggggagacacaagggcccatggaccttgtgagctagacatcaactctatcaccagttcccacaacaataggagaattacttagttaaattccacaatacaaacaagacaaagctacctgtaaaataccaacctcatctcttctccctggctctttcatggcacctgcggtctccccagatgtcaaggttcttgctttactttccaaacaattttcacgtttcgcggaattcctatttcataaattaaagagattaaaaaaaaaaatcataaagccatagaacaaatcgacacaaaactaaaagacaagagactgcgaggagcaaaacaagattcataatccttaaccttctaacttttctatctaaatatgaacttataacaacattaactacaaaggttaccttctacgattagtgccccttctgttcttgccagaattgaaggaagaaactgccacggccgacacgacattttcaccctcaatctcccctgcaacattggacgaaagcgagactccctatgaaaataaaaataagaaagtcacacaatctggctttaaacgaatctctacaagtaaaatcaccatagaaaaaaagaccaacctctgcaacaatttgaacaatattggaagacaaaatcacaagtgtctccacaatcttcccactttctacattcgatttacttcttcccttcttagtaagttttgcattcttcaacacaatacctaaattcagaatcaaaccagtaaaattcagaaacagtcaaacagaccaaaatgctacacaaatcgaaaaaaaactagcaatgttacaatgaatgattcacaccaccaattaagtaatgagcataatttcgtaagatcctaatcaaatctctgtgatctccgacacaaattcaaagaccaatttcatcaacgaaaacacaaattaccaaatcaaaaccacattaaaccaaaaggaaacgtactgaattcattctcaagagagacagtgtagaatatcccagaaaacacagagccatcgttgatatgcacatggacttgtaagccgatgatacacatagtagagattaacagagcttcgttcagcgatgatgatgatgacgaaggagaagagcgtgagatctcattttccaatttcttcgcgattgccatattcaaatcaaatcaattcgttccaaaatttcacagtccggtgtactcgcatctatatatatatgtatcgcaagttcacaacaaaagaagacgaagacaaatagggattcgagaatcagaagagatccagagaagatagacgagggaagcgaaaaaaaaaatgctttgttattgggcctttgtgtatccttattgggcctagattagtttttttggtaattaaaaaaagcatcgtcactcatcgttaaacccttcaattggctgcttcaacatcttcttgtgtatctatcaaatcttaaaaccctaacttttgtctgctcttttgcaaattctagcctctcaagtcgtaagctttccatatctggagctctaacttcgtgtttgtgtcaag

SEQ ID NO: 344 - DNA, 3000 bp, Arabidopsis thaliana
gtaacaaaaagataccctcacaaattatgttctccatgttgaatgtgcaaacatatggacagggctccaatgtcttattggaaaaaaattgttttaagactttcgctattgactggtgtctagattataacttttcgatcaactgcggaggcccagagataaggtctgttagtggagcactatttgaaaaggaggacgcggatcttggaccagcttcgtttgttgtgagtgctgcaaagagatgggcagccagtagtgtaggaaattttgctggcagtagcaacaatatatacatagctacttcactagcacaatttatcaacactatggactcagagctttttcagtcagcacgactttctgcatcttccctaaggtattatgggttggggctagaaaatggagggtacaccgtaacacttcagtttgctgaagtacaaattgaaggttctaactcttggaaaggtattggaagacgacgttttaacatttatgtccaggtctgcaccacttgatcgagctttccggttcacaaatgttactttttggttctgatgaattctaagatctagctccatttttccagggaagacttgttgaaaaggattttgatatacgcagaacagctggtggctcttcggttcgagcagttcagagagaatataaaacaaatgtatcagaaaatcatctcgaagtccatcttttctgggctggaaaaggaacatgttgtattcctatccaaggggcttatgggccattaatagcggccgtcagtgcgacaccaggtaacacaaacggttgatatattttttttcctctgattttcactatctcccgatactagttagtgccgtgtcacatattcttgttcagatttcacaccaactgtggctaataggccaccatcaaagggaaagagcaggactggtactattgtgggtgtcattgttggtgttggacttttgagcatctttgcgggtgtggttatcctcgtcattcgaaaaagaagaaaaccgtacacagatgatgaaggtacagatgtaataagaacataaacaagcccttgagctgaataactttagctctctgatcaaaattaaagttgactatcatctgttaaattggttgattttaagtagtgaattttttatggcagagatacttagtatggacgtaaagccttacacctttacttactcggaacttaagaatgcaacacaagattttgatctctcaaacaagcttggagagggagggtttggggctgtttataaggtaagtcccttactgaatcgaacaaaatagctgtatatttttctgagatactaggaaagaagggtacatgtaataccttttaatacgttttgttttgaataacacgttcaacagggaaacctcaatgatggaagagaggtggcggtgaagcagttgtcaattggatcacggcaagggaagggacaatttgttgcagaaattattgcaatttcttcagttctacatcgcaacctagtaaaactttacgggtgctgctttgaaggagatcatcgtttgctcgtatatgagtatctccctaatggaagtctcgatcaggcattatttggtaatgaacagaaacatgacttacctatctctgcttctgccaagctaaagtaatcattatgccattgggttggatgttacaggggataagagtttgcatcttgattggtcaacccgttatgagatatgtctgggagtagccagaggtctagtttatctccacgaggaagcaagtgttcgcataatacacagagatgtgaaggccagcaacattttactggactctgaactggtcccaaaagtttctgattttgggcttgcaaaactatatgatgacaagaaaacccatattagtaccagagtggcagggacgatgtaagcaaaatccatagaccctgacattttgtttgcaacacaattatggctttatagctcatgttagttgtatcaatgcagtgggtatcttgcgccagagtatgccatgcgtggacatctaacagagaaaacagatgtgtatgcctttggtgttgtggctcttgagctagtgagtggaaggaaaaactctgatgagaacctggaagagggaaaaaaatatcttcttgaatgggtacgtctatatttgtcatataggcgaagttgaagatggtgtgataaatgacaaaagccgataatccttttgtatttcttgtatacaggcatggaatctacacgagaaaaaccgtgacgttgaactaatagatgatgagctaagtgaatacaacatggaagaagtgaaacgcatgattggcattgctctgctttgcactcagtcatcttatgcgttgagaccaccaatgtcacgagtagtagccatgttgtcaggagatgctgaggtcaatgatgccacctctaagccaggctacctaaccgactgtacatttgatgacaccacaagctcctcattcagcaactttcaaacgaaagacactagcttctcgacgagctttatagcgcctggcccggagatgccacttagagacggcgaatcgaagccaatggttggattcaagatcaaggagggaagatgaagattgtcccctctataatttgatatgcttgtatatggaagttgacaattttcttctatataaggatgtggagaaacagatttcactttcattcaataataatattttagttgacaatttttcaatttttgtaacaaacttttgatatcttgcaaggatgaccaaaaaaaaaaaaaaaaaaaaaaaaaaagaaagttaacctgttgtgatgggccgggcattttataagctagtacaactaacacaccgttaaatgggcctggcccattgaatttttcaagagcagcgccatcaacagatgcgcttattaaacccctgaaaccctagtttcgttcgttgtatatttcttctcgctcagtaggtctttagggttttagtttcttctcctcaaaaa

SEQ ID NO: 345 - DNA, 3000 bp, Arabidopsis thaliana
atggtagaaaagtaaatatacaaaactttactttagctctgaaaatcctaccacaagattttaaactcaagaatcgatctgtagaggctctggctcaggctcaggctcaggctcaggctcaggttcaggctcaggctcaggctcaggctcaggctcagctgttatttctgcagctgaagctgaagcttcgttttccgctgtttttttcttctttcttgtgggtggttcttgtggtttccgaatcatttctttgtttgggaccaagataatgaacatatttctgtccctgaagtttttgctctcttcagttgcaagctacagatccgggacaagtttcagtgatccattcatttcacagtcagtacacattgaaatctgatacatactttctatatataggaaagggtggagaacgaacttattacctcccctatttcggtttggaaacgtctgaggagttcaatagcgatatttctgaactcgttttctcgtcctttcatgctcacaatcaccttaacctgtgtacattacaagtagtaaacaaaaaattacattcagacgggacagaactctaacagctcgtgaagaatatgggaacaaccttgtcaccatcttgcaagaacttttgggcagcccttagacgaacggaataatcatgctgatcaatattataactgtcagacaaaaaaaaagcagtaacctttgagaggattcagttctaaagaagtcatttgcaacatcacagacaaacaaaaaaaacgaaagccgtaccccattttaagctcctttaaatccatgcgagttgctaatatgatataacacaaaaaaaaaatacataagctgataagcatatcatctccaactctaagactaagaggggcagaaacagtcaatacttttcttttgctgatcttttttcctcttttgctgttcgtatctgtatttactgataaacgcaaaagaaagaaagcatcattactggtaattacggcacagcttggcatatatcttcaatacatatttagatactcacctgtagtccatcattttaacaaccggaggatctgcatcaggcgatagtataacctgaaaaccaacacaatcaatcatttatagttggttggtttagttacactagagactcggtgtagctaaattaatttatgaagttctgatttgcttagtaaagagaattttatatataacaatgtacattctcttcttcttgaagaagagaataacataaatcattcacaactcttatccaaattctgttaatctaatacggtatcagagcatatcttctaatatttgctttgattctagttcaatcttccatctattagctcaatttcactgattcgagttctgactcatatcatacaaaaaccattgcatatatcaaatagctaatgtccacaagtaagagcatttcaatggaaacacataccagatcaagttcagcatcatcagccattcgaacggcttcgtctttagacactaaaccaagctatagagagcaaaacaaactggaaatttatgagtcctattatgcagaatcaaagctacaattcgaagaatttgagtcacatttaccatgttttgttgcccatcgataagcctaacagtagctgacctactcaaacatagacatcatcatcaacaaatcgaatcagaaagaaattttcaattcacgattaggcttaagaatcctcacctaattgaggagatatcaagagcttcatcaatttcagcttctttcggcctacctcttctattgtctccagagaatcgataacctccaccaccaccgccgaagcggcaagtgacggcgaaagcacggcgaggagaaggagtgagattagtgaaagacagttcggttttggagagacgaagactacagagtttggaatcaacagagaagagtgaatgtgatgatactgttttggttattccggtgaagacggcgttgaatccaacggtgctgctggtaatcccagccatggcgcttcttcttcactcagaggtttcaaaccatcacgaagctcttatccagaagaataaaacgcaacggagaatgaaactacgtcgtttccaatgtttggaagctaaacgtcaatgtttttattaatgggcttatgggctttaaaacaaagggcccaattactttttagtttttaggatttttattttaacatctaaactaaaaccagcataatcacattgaacatgggagaaatttgaggaatatcatgttcctaattttaaagggagtaaaataaagttataatttgcaaaggaatctatgcatataaagttatttttttattttttaagaaattataatctaataaaccaactatatttattattatacatatgtatatttgtcaaatttacttaaaaattcataattttaggaaacaaaaataaataacttatagatagaggtaatctttgaattaactaacttaactcatgcaagagccatgccaacaacacttttaatgatgcaacaaagatttttatttttatagtgatgcaataaatacaaaataattatgtcttcatttcataagattttccatcaattatttttcccaaaaattaattattttgtgttggagattatagacagaggatactttggtaattaattctgtgaaagtagacttgtattttgataatgatgcattaaaaacaatattaagtctttatttcgtaagatttttccatcaattctttttcaataaataaaattattttgatatacagaatattttcgtaattaacaataacatttacacgtgagaagaagaaaaggaaattagggcaaaccacagaacacagcttcagccaaaaaaaaaaagggaatcgaagtgattttatcttctccaccgtcaatacagacacatatatatacactatatacctctatctatctgcaaaacttttttttattgaatccttctaattgcgaaaaaacaagagaatcgagta

SEQ ID NO: 346 - DNA, 3000 bp, Arabidopsis thaliana
aatattcttcttctgctagtcgtttgccatgataccatttttgtcaccaaccaaaaatgatggcaaatgatgtactactaaaaactatgtgaaaatgatttaacaatagttttttacaattaaaatgaatatttaaacaatttagatactataaacctttataaagaagaagcaattctttctcttactactagttttgaaattcttgtataaatgctgaatatattggatcacgttccttaaccacaaagagaattcgaagaacgtagtgtcgtaatctggcccatggtttcttctatggatcatgcaaaattaacaatttggccgacgtgcaaaacaaaaaaagaaagcaaacgaatatttatgtgtacgattatgattatctatatatgtattttaactattattgtatatattcattcgtggggtcgaatggtcacttccaagaatttatgccacatttcaagatatatgttcagccgcatggccgacatcatcgttatagtttgatatcttataagggttcacgatccaaatttttggtacatgacaaactgacgataataatcaaattagtatacgaattttcgctatgtggatttaaattagggttcaagtgcaaagatgttgtaagtatagttaatcgaaatcagagaatctaaattactttaaattaatgtctgatcaatatatgccgcacattctattttctataacataaggaattttattattatttcaaagtaagatgagatactttgtcaacccatgcacacaaaatatgaaatatcttatcttttctttcttttctatttttagcaaaagaaagaaagaaagggaaaaaaaaaagaataatatcttttgtgcactacactatcataagagttcagccaatatgcaacacgagccatttggattttggtaggatggtttcaatggagttactaattaatttccgtataatggaattaactatatagcgtttctcgactcaatagtgacctccgaatttttataaaacaataataataattaaaggcaaattttgattggtactgtttgaattaaattgttaaaaatgtattttgaagaaaaagaggtcatcacgacgagcttccaaaagtggaaaagtctagtgccgtcacgttcagagactatataatacaagcaaacaagaagttacacttatttctttttccttttctgcagttttcttcacgaactggaaaatctcgtagccgtttagatattttccttgcatccttttcacgagagttttaaaaaacttgaacaacaccggctaaaaaaggtttctcttttgtttggaacgactctattagaaaaacgtttgattgttctaaaaggttggttaaaattaaaactcttgacataataagtcttctattttgttttattttaatatacgtggtgacaagacgacgcatatagaagaagaaaatccaaagaatcattatcactgtgctattaaaaaaatttcatcgattaaaagttaatagagacatgtcgacaagaaataaaagttaatgtagacataagtgagctatagaccgacaggaaaataaaagaaaaacagttaatacattttttttatttatttatcaaacagttaatacattattaaagttaattcagtcatcgtgaaaaatgctttgagtgataatcaaaacgagatttagcttaatacaaaccaactactatagaagaaagaaacagaaccctttattaaacataaaaataaagataccattcgtgctacatcaggaaaagtattcgacaataattgaatggagacactgcccattatgtttgatatgcatatgttctcgagatgttgtgaagttctaaaaaatcgaatagagatatgcagatgttttttaaaagatttatattccaataatgggctttagctgccctctttcctttgcaataatgggcttttactctaatttgtagtagtttttttttctataccactaacttgtagattatttcaagtaagagacataaacaaatacagtataaccacgtttgtaaattttggttaaattctgcttagcaaaatgccccccaaataaaattaaatactataaacaccaagtttacaagccaaaaccaactacactactacagtatttttaattttaaagaatccacaacatacaccattaatatcataatctcaaacccaactttaatgacttttgattgccacttaaaacatctctacaatacctcattttacatgctccaattccccattaccaactataatcttactccatctcttattcaccacttacatttttccaaatcacattctcaccaaaaaaaaactgatttcattataaaaactctcaacatttttttccaaatataatcaaaatagttttcaaaagtagtcttgactttcaacattacttttttttttttttaacatcttcattttattgatattgtactttcaacattccttttcctccaaggctttcaaacaagataatttgtcttcttttttttttaatttatttaaaatctttttttaatgatgtataattggagcctcctttaaattagggcccaaacggtggcttcttttagattataacccagggccggcgcaacccttcttcttaacaaaaaccttttgattccaattgttcttctctcttcttcttcttcttcttcttcttcttcttcgccgcttcttctctctcgaattcaccccatctcaagtaagcttctcctatttccttgttataccaaacaaacaccatcttcaagtcaattgattttgttaccctaattgttcccgtccccgtcttgtaatataatcgaaaaatcgaaactttctgttttagagacatggattttgtgaaccctaattgttaacgaatcgttgatatctgtgacgtatataaaccctaatttcgttttcatgtttctttatctacgcaggtgtacgttagcctcctccctcta

SEQ ID NO: 347 - DNA, 3000 bp, Arabidopsis thaliana
agaaaagtatgtggaagtgtattatgtttattgattaaaaagaattaaacgataaaaaggtccaaaacattagatcaaaacttaagctagctttgttaccttgatttcgactgaagtatggtataaatctggccccgagccgactgaactaacattttcagcattatgttattcgaaatttcgacagtatgataatgagtatatttaaaagaagcattatgtataattttgagagaagaaaagattgagcattttttagtatgttttttttttttagggtgaaaattggatctaaggatatttataggaaacaaatggatgaatacataagaaggaattaatatgtttcgtcatgaaccaagtaaccaacataaatagatacattttaaactttttataaaagcagccattaatagaagatggtcttttaaaattggatttgttttatttgcttttcaaattttatcacaattttgtcttgttcatagtttttaagaaaaatattaaccacaactttgtcttgttcatattttattttacaaaattggctaaaatcacattctatttatttatgagttttaaaatataaattagattttggtgatattcaatttataatattttaataaattttcagtagtctctctagaaatatacaagtttttttaatgtacctctaaatattttaaaatcaagaaaatcaatctagatatggttctttataagaaagtacacaagccaacaaacactcgtagtctcgtagatgtttttatcaagtatatatatatacattcattatactattttcaaatcgttggtaaatcaactgataatttttttttcctatccattatatataaaacaaatataaatatgtcgcctattacatcataaaatttgaggaagtaaaaaaaaaattgaaatttcaaacctatcaactaaattttctgatttaacagatttaatttatttttatttttttagtttaaaaaaactcattcattaaacatgtgaaagtgactaaccacgatgtctagctgtagcggcagtttaataaagctttaagcaatgatctcgctcgccggccaagtttagaaacaatgaaagatcaaattgaatgatttgttttcttttgtcattcgtgaagacaatttaaaaagatacacgtgtagatgtgaggttatgaacaggttattgttttaaaacacagcattatatcagccaatatatatcaatatatagacgatgttcggtccaaaaatctagatcaatctccttcatgtttgctattcgaaaatgattgttatttatatcaaatcgtgcgtgtaacatcgattgataaatattggaaatttaagtaaaggccaattgtcacgtaatgacttgaaagcatctccaatgtaattcagtatttatttcttttcacttgacgatagaagaatttgattagagatgagttacttattgagcgaattaatgtacgttattttctatgaccatatacattccaccgacatcggacattacactgctgtcggaacttaatgatttatttttctaaatacgaatacatttctccaatggaaaaaatctaagagttttaagatttttctataactgtaattgtcatttcaacgaagagtttaagaagaaaacagagagaaaagcgtgtaaatatctgtagttttaatcaaatgggtcatttctatttcagtctatatatttaatcaaaattgcaattcacaaattttaatgcttacgtattttaagtaacattaaatgaacatcttcgtcctaaaagttacttgatattaatagaaaggtaaagtaacagaacaaagcattaacgatatatttatatttcaaaacttacacacaagtattcagaattaagaaaagaacaaaacaaataaaggagacgtttctgcgattatgtttttgcttgaaatagaacaaacaaacacgtattggtaaagaaaccaataactttgaagatagcttaaacgcaaaatatatagtgaaaaaagggaaatcaacaattattatatatccccacgaaactcggtgtcggtggctcaatcatcttaacactctaaacttttaagcccattcgtgcgcatgcgtgtatgtatatacgtgtgcattggatttgaaattttggtcgttatcgagagttctagtagattatgcattttgtgtaacaagtgtaatataattgggaccctttattactttctataaaacttaattcttttaacctatagatcacccgtttgtcaattatatcaatcaagggtcccttattagctgcattttccgatcgataatagagaagatcatccaatgctttacaatcacttccatgcgacctcacatacaattacttccattgcatagtatgtagtaaaactatatattttgcttccaatggatttgatgcttgtttatgcttagaacttccaaataatcttttttaacgtagcgaattgattttgcattcaaagcacccttagtaaatccgtttcctagtctagtcccataattaaggtaaaatctacatgggcttctcaggcccataatgagaagtttaaaaggctcaactcaacaagatttagttatgctaaggccttacaagttacaatcaaacagaggatagggaccgtcggatttatctgacttcctctccttcgattagggtttctgaattactactcctctgccaattagggtttaagcctctccagcattttctttcagctcaaacccaagaacctcatcgccgattatttcttcatccttactctatcccgcgccgattaatctctctcaggtaaactacttcaattttactcatagactaattgtacagagattgataaatcctatgttgttcccattagaatgttcaagggtttatgattattcaggatttcaaatctgaattattggacaaataaaccctaatttcgtataatttgcatatcatcagtaccgtccgag

SEQ ID NO: 348 - DNA, 3000 bp, Arabidopsis thaliana
aaaagtggtggtgaaggatgattgtattagtgttgaagcggaatgcacgcccaatgtggttggcttactcaaaagcagttcctgcaatctattctctataaacaaatacgagtgcgacgtggccgaccttcccgtgatgattctccaacaggtatgttctttcgtttcctaaagttgatcatgtctatagcaacacggtcccttaaacacgcggtttatttatttgagaaggtggcgagccagatagtgtgttggctactggaggaagcacggacggtagggacaaaagcgagcagggaatttctgtcactatcgttagagatagtggaaggggagagagtgagcctggtggcgcatgtaaacccggaagacgcaaaaggatgcatctcgtggtggctagtgatggagaatggatgcacagaggagagggaaggagtgtcggagagtaggaagttgttgggtcatttgtctctggatgtcttgtactctgttctcatggatttgatcaacttgtgtggtactggtcgcaatgctttagagagattgtaaatgctgaaagacaagtagtgaacatgtttagttcttcaagatttgtagattacaatggtttagtgagactctagtgtctagcccaaacatcacttttttgaatagttggaaatgtggattttatggattaaggattgatgattattataaaacatctttatttcaaataatattatcaatttttcttttttaaaaaatctttgaaatcataatgactttagtacttaaaggaagaaaggggtagaattggaaatatgtagagaaaacgagaataactctgacgcgaacgtttctctcctccgtctctcgatccctctcttgacgtctcgctgatctgttttgctaagattcaagcttcaaaaccctaatttctctagccattagcatcgatttcagctcaacttcaggtttgctgttccctttttttgtatcatcccatccaccgatcgatatttctcaattttctgatttgctgctctctcgagagagagtcaccgttatggagttggattcactatatgatctgataattatgaaattcacagatgcttctatatatagtaaatctgatttattagtgacgaatagatgaacatattcccttgattattcttctacaaatctcggtagtgataaattgttaggttttgacgataattgtacttgctcagtttttcatgtgtttagttatgattcttcttgggcatgtctgtgtcttcgaatcgattctcatgtgattcccattattgttttttttcttctggttatttcagattcaaggaaacaattattagcttctcaagtgcttcagtgatccgatacaatggtagttattgccttctctgttccattgttaaattttgttaatttcagtgattttgagctaagagttttgtttatctttgataaattcagtcagctttgttcaatttccattcgtttctgacggtggtgctgcttgtgatctgcacatgcacatatctgaagatgcagttccctgccattttagagcagaaaactgggtttgtaccttctttgttctcctttttcgtgaattttattctcaaaaccgataacactaacacatttggagctttgacaccggttattgttttcaagcattgtcttttgccaaattaaagatgctttgtcagatttctctgcatattgttactttagattgcaaatgttacttcatcctagtgctttttttgtatttatagcttgcatctaatgccctcagtcatcactttgttctatgcatattaatgatagaaattgcttgattaattactattgcaggtttcgaggatttttctggaaggctgctagaataggtaggccttttcacccctttggagctcagttatctcttgtgatttcaaaacctttctaaaaacattgtgttgaacaatatttctttgcatgtgttctatagaaagtagtgataggctttctaggagcaagaactcgttactaatcaatgcagctactaacaattgtactataaattcaactcatgaataccagattctaatgctttaaaacccatggtcgatctcctatttaagcatatgcatgatggcatatagttaagtctatatcctcctacttttactgccatttgttttccatcgccgaacattctgttgcttaactttgctttgtcatcacttgtaccaggtgagcgtttgagcccttgggtctccgctggatgcttcatgatgggtgtgtcgatcattttcttttgagtgtcaacttcttacatatccagttcttgtagatttttacttctttgggatgctcatttttctgtatgcaaaagattccaaggggttgttgatgaaactgaaagagtagaatattatcctctttggattatggatatggtcttgtatttggaacaaattgtgtctgttattttaatgtggagacaagtccataaagctcaaccatagaaattagtagagcataagacaccagaaccagctaataaaacgcatctttgtcgtaaaggaagagagtaatcacatacgtaacttcaagtttactaatttcattgaactaatgagagcatcagttaataaaagtttgttgtgtgtgtggtagctgtaaaattatcagtcaatttggataatcgatcagttttatgcgagcaaaaagaacaaaggtgaagtcatggttacccttttgggctttaatcaaaatttcgccgacaaaagaagaaactaaaaaaccaaactcccaaagtcaaaactagttctgtcggttaaggttagttcacatgggccgaagtatatcatcacccaggcccattaaaaagatgtataaaatcgacaagcatataagtaacagcgtaagcctaagttatcattcagaatattcaagctgagaaagtcgtagcctctaaaaccctaatcctctctgaaaccctagacatcgcagctgaaa

SEQ ID NO: 349 - DNA, 3000 bp, Arabidopsis thaliana
tgaacaagcaggaacagaaaaatatacctttaaaggtgaaaatgcaaatgtcacaatagcattggagccaaagtttgtaagaactgcaagactgatccctctccctcttgtgcggagcgggaaaatctctgacaccattagccagctgatgggtccaaatgagatctgttcgcgctgagactttagtaatatgctagataaaactatgtagccacagctaacagtgagctagagtacaaacctggtaacaaccaacatagagaagcagtgcaccaacagcgacaaggggaaagcctccgagaaacttgtagtatgctgacagtagaaacaaggacaacgcctggaatttggaagaaatataagaaatgatatcttttctttggaaaataagaaacagaagatatagacataaaatgaattcatacaatgccgctgacacctccaatcagtaaaggtcgtctgccgagatcatcaactttcgcaacagctacccatgtcatcagtaactacgagagcgttatcaattgaagaggttagtattgaataactggaagcttgttggaaaataagatatttacacatccaaacaaaaaaataaaaagggccaccttgaaaacaccaataataacagagactcgagttgcatcagcagcagcagagaatccagcagtctttgaatagataagtgagcataaagtctcattaaacatccgactaaaggcagtaaaaattagtaggtaatctcattcatttcaatgttaaggcgagcatacctgaagaatcgaacccgcataataaagaacactaggctgtccagttatctgtcacaacgaagcagagtgtaaattatttcaaaaatgctcacacattcatccaaatggaaacagcgaagaagaatcacctgttggaagaggactaaacctccaccaattgtcaaagctttcaaattaggcccttggaatacttccaggaagtttcccccagatttctcatcttcataggccgttttcacagataaataggcatcatctaccaacttctctgagattttatcacctggaggtctgccacgtaatttgctgagggcaagcatggccttctctttgtattcttgtaattgtcctttaccttggacagctctaagcagcaaccagcgaggagatgcagggagactccacatgcctagtcccatcagcaaagcaacaggcgtaccaaatccatacatgtaacgccaccctccaactacatcaatctggaagcttccaacagaaaaacccaactgcacaagaaggaaatcaatatttacgcagaaatcatactgggaagagattgacatcagacacttaccaaaattcccaatacgatgaagagttctttcagagatatcaaagttccacggatttgagatgggcatgtctcagcaatatagaggggagccccatgcattgcctatcaagcaaaaccaatttacataaaacattaactaacaatcaacaacaaaagtaacaaagaaattaccataacgattcaggtttccggagctcaccaaaccaataccaaagccatagagaagccttccaactaagagaatattaagatcaggggcacagccagtgatcagagacccgaggagatagagaacagcagctataataagttcccgccttcttccttcataaagatgtgaagaaaaccagaatgagatacttgcattcagttaagaagaacgagaagtcaacccaaaaaaacaagacttaccaaggaaatcagcaacgccatagacagaaattgagccaagaagggctccatacaaggatccgctaacctacacaacaaaatgcagtaaaaactatcattttctgctaactctatggcttaactacagaaaatatcgatctccaaataacataccacaagtcctagctgaacaggtgagaagttaaaccatgtagttccgctaagcgcaggtgactgttcaagaccatatgagacagtacataatgttaaaattctgaaagctaaaatgtaactagatgaaaatagatactttaaaataacctgaagtgagagcgtagcaccggaggtagccccaatgtcatacccaaacaataatcctcccaaagccgggaagataaacctacgattcaagtaaattactattaaatcagtgcaatctaggcaaataactaattttctatcttctataattgatgatacataaggcattgctaagagattaagtcattaggcaagatcattacacaggcaatccaaatccattactcaggaacagttaaattcaaattaacgagaaggatcaatacgcacgggagtatcacagaagaccaagaaaatgactctggtgcatcagaagcaagcgaatcagctacttctccactgtcggcgaactctcctcccgtctcagctccgacctaaccatgaaccaaaaccggaaaaatcaaaacttttgaattttttttagaagaaatcaaaatcagagaaaattgcttttcacctggaatatatgtctgtatctagtagtgactaaacccggtttggaaacgaagcaagtacgttcctttaaactaaggtaagacgagtcaggcctcgatttaaaacacgagcagaaagtacgaggagaagggttcttgaagtggtctcgttttaacgctctgattgcgaaatgtgactgaaccgagacagcgaaagccatgatcggatcggagtgagacaagtgaggattctcccgctaattttggtcgcttatctctcatcttcgagattttgactcctgatattatttttaaaaaatcgattctttccattaatgtgtggttgtgtttaaagcaaggacacgattgtaaattgacgttttagggttttttgtttgtgtttggcagagtaaactatttatagcgagacaccacttactcttccgccatttgttaaacctctaaagctcgtgagaaccaaaagcttgaatcaaacgcttttgaaatc

SEQ ID NO: 350 - DNA, 3000 bp, Arabidopsis thaliana
ttgccaaccgaagacctagaagcagagatttttctttatcttgtcgacaatttctcgaggtattcagggtgactcatttgtttcaatgcacgctatttcaattgagtgagttctttgtctttttttccgctgtaacctctaacttatccatatagtgaagcatcaggggtttttccaggcatgtgggaaaattctgaagtctcagaggcagagggaagcttagaactcgggctcagtaaatggaaagttgaactacttgccgcactacaagtgggtgctacagaggtccaatctatgattctgaaggtagtcttgttttaaggtgtttcactttttaaaataatatctttgttctcaagcttgtgtttttgtttcttcaattttcttgcagggtggtggcatgatcacattcgccaaagtttatcagttggtatgaaatcgataacagtttgtgtgtttaaacttcttcttctctgaggcgatacaaataactggtatattctggccctatatagttggctaagaaactatctggaaaagtattccttgaagctgccaactaccagattaggaaagagatgctaaaaaaggtttgcatctgtatttatttcatcatgctgcataagaatttttcatcatcactcagggatttgcgatgcactatatcatgaagttcctgagaagcattacatgtcaatgatgtaactgattgatatgttgatacgttaacctctttttacagggtgggcagtttgctgccattaacttggaatctcgagcagctctgttagcagcgaagcatgtatttactttttccatctctcgttttttttcttttcttttctatctctctattgcctttgagctatcttcattacacaaactacatttcgcctaacaatgtgattacagtgaccttaaattgatcacagggatttgcaggggctgcatccagatacattggcttaaaaacagcgatgcaattacttggccccatgtaatagccactcccctaatccgatctaacacagcatttacattacatatgcacatgaatctgcatctaattcttcttaaattgtttatgtccggacaataattgtggaatcttcaggatgtgggggacattactggctgacttagtgattcagatgctcgagactgactacgctagaatcctaagagcaatttacgcatttgcacaggtacttctctttttgcaccaaagtctgcatttgttttgtagtaagatctcattgactagatttaatgagtttaaaaggattgttttgttttgcagattcggatcaccaggacatacaggctaccttgtaaatgaagtaacagtttgttttctcaatctcagtgtccctacgaactatgtcggtaaacaatgtttttcacactcgtataattcgcttgtggttgaaatcaaattagacgttactcgagtagatagagagtggtccagagaattgagcgttttgcgaaacaatattttggagccatggaaacatgttttacagattttaaaaaaatctgattccttagtggtaacgagcggataagcgacgtgtggggttcactgtgacacgtgtggggttcgcgaaacaaggtaaagatattagtcctctgagtgcttaccacgtgtgtggtccgcgaatcctcgaaagcaacggctcttgtttctttcacgacgataagccgccgcgtttcttcacgtgcctttttgtcggaatttcagactattctagacaacaactcaacaagtcattataaaactaattatgctatagtcgcgaaaataatgcgttactaggtgaattattactagattagtagtacacttttatttcttattgtgaagacttatttagattttatcgagttgtcctatatagccgacttggtataaatgatcctcgattatgtcttaaaatctctattagtgtggagtgaacatacatggtgtatcagtatatggggttaccaaaatccggagtgatcaagtcatttttgtttttgtggttattatttcaaaacatgtggttaatttatttgtggccctcgttgagaacaagactttttattgttttagaaagatgaataaaattcaaattgaaatttgatatcacgaaacctctattatataatcgtccaaaaaatgatgacgtgacgtaggagacaaggttaaaaataactaacatatggttagataatatccaatactttttttggataaaaatattatccaatacttgtggcatttttttttaattcttttcttattttaatagctaaaatttataccaccaatatataaataagtagactttcttaatcttacacatgtaatacaaatttgttaataactttgattatgtgattttcttattaattttgttgggtaaattttctagggtatttattctataaactataaaatgtacattaaacaaaatgtataaaattaaggaatacataaaggtggtgattagaaaattcataattgttggagctttttatagataggatcatatgataggacggtcttttagggtaaaaaatacttcaaaaattagtgtagaaacaatagtgaccttacacgtgtaaactctggaacaatctactcgtctcttctcttacatacctcaacccaaagctacgaagacaactcttccaagttccaaacaaatatcacaaaaagtaataaactaatcaaacacaaattctacaaatacagtgaatttgttgtttatttaatttgttcaacgattatcctctcaaatcctttcactatcatcttttccttattcttcttcttcttcttcctcttcatcggccattataaagctctgttttttattaccctgttttataaacagaggaagccctaaatttggattctctattctaaagttttctcatttcgctaattttggagaaaaacgattgttttttttaatcgtttcttcatttctgattcatttttcttggttt

SEQ ID NO: 351 - DNA, 3000 bp, Arabidopsis thaliana
agagagagggagcgatagatagaggggagagatggagatatggatttttagatattacactttgtgtttgtgggacttttttttttctttttttgttgttgataacttctttctttttggactttgttgtgtgggatatataattgtgacgatttcttctttttttgagcaataattgtgacgatttcatatttaattatttatacatcatttcacgacatttcaattacataagcttcaaggatgtggtggcatggaagtctttcattataagtttatttaattaagcatattattcttgtccacacaaaagaatataatgccacaattttcaagataaggtgatatgttattttgatatttgtgtgtttataattaaacgagtatcaaaagtctgggtcaaacgcttgcgaaaaggattgtggatttgactcgtggcagcaaatctacggtgtgtgataaacaatcaacaatataaatgtggttagtgtgaaacttgatgctttagatattatatttgttccaaatatattatattatattatcactataaatatttttgatttagttttattataaattattatgaacaatcaacaatataaatgttgttagtgttgaactttcgattttagatctacttattaggtttttctacaaattttccaccaaaatctaaaatttagaaaaaaattgaagagtgtatatatgttttcatgttatttaatcgatgatttttaaatgtgtttttctttgtcatgtaatatacacgagttcgaattcggatagtaacacatccgtgacagtagcccaaattaaatcactaatcatctttttttgttaaagccttgaaggacttccaaatcatcaataatatcttctcaaatgtgtaattagtgaacttgaaacttttgaaaaataatttgaaatatctcgttatacgattaattatatgaaaattcatagaaaatgtgatgctaataggaatatagcaatttgggggaaaaatctaatgaaaaaggattttatgaaacttcatatattattactattttttgttaaacatgaaatttggagtgacttcaaacaaattaaaaatatgaaatctcccatatatacaacatcaacgtaaaaaaacaaaaaaaaagcctcattcatgcctcgttatcgtcggattctatcgtattgatctcttcatggtagtctccattattcatcttgaccattcgttgttctcatgtctctcttaatctccggttaagctctgattctcactttgatctcttgttcgatctttctactattattattgcatttactatttaaaattttatatcctagtagttggatctctaatctcttattaacaaattattgacgtagatgacaaaaaaataaaaaaaatcattgacgttaatcttacacattatgttctgtgaggtagtagaacaattttggaggtaacacttttctttcacagttgttgtcttcgtcaaaactatgggcctagaggtatctaacttttgatacgaaaattctccttagcagcattttaaaaaaatcataagagcccactgaatctcaagcctttttataatcattagaatatatttgatatttattaaaagcccactaattttaaaatccaccaaaataatcaaaatccttaatccaatagacccttaaatagttaaattatttagaaactctaacaaattcttttatttaacaaccttcctaagcttaaagtttgtaattgttttgtatttttcccaaagttttagtatcttgatattttaagatcgttctataaatagatttgattttgtaagttgtttatattgttactaggcctttgtataaataccaaatactttgattatttttttactgatttcatgtcaaacaaaattccaaacaacttaaaggaaaaagcttactcgattggaataaaaattgtacgtttaacaaaatgatattagtgaaataaataaaccagctcaacatttaaggatttctacgtgtatatacagtaatcgtgtttagtattaattagctatagtttagcctcaaaaaacaaagatccaaaacaacatgacgaaattgacttccacatcgtgtcctttctcgtcgacataaaaactttaatatatagatgcatgtataagtatactcactatttgtgtcattagtattttcttttttgatacttggagctaatgacaaaaattccgctagaaatatcttctccaacgatagctacaaacaaatactaccattgcgtcatcatcacttatttatattcgatatttcagtcaacaacactaatctctttcaccaaaatctttggactattattacaaatgaattaaaaacttggacccttaataacatatttgtttcattaaatctatacaactcttattaaaaatgatattttcttaaatcaaaaattaatcaaaattaaggtaggctctagaggattgcatcatttgcccacccacattagcctgccattattattggacggtaacaaatttccttacaccaataaatggtaagttacaattattattaacatttctatataaaatagtttggttatttacattaatttttatttaatactataaacttaaaaattcaatgctgaaaagtgtaacggaaagagggacattaaatatatgttaatataataagtatatttactatttaaaaaagacttatgtaaatacatattgtatagagagaaaaataacccatagtataaaaacttgcatctctaaaaccgcagcattgataataagagtctctttcttcttaagtatctcttaattaacccacataatatatttacaagtggccgcctcatacatcccctctcaagtcctttgcttcatttcttataaaactaaaccaccttcttcttcatcattcatcaccaatctatctcatattccatatactgaatatggactcattctacttctgtatatacac

SEQ ID NO: 352 - DNA, 3000 bp, Arabidopsis thaliana
gatttgagcctagtagtttcttaaggttttaacagactgaatttgtgacttatctttttttattttgttggtttctttctcgttggcataatggcatgtttagatttcggtaactagagtggtcgcaaagcttttactatgcaaaaagtttacttaacaagcctaagaagactcgatagtttgttgcaaaactcatacatcgagatagagtgaatacagaaagagaagcaaaatcaagtgtaaaacaaccatggggtgttataagcccatttataggctaaactcccatataaagagtcggacacaaataaccgacctaaattcgaaggaaccgaattgaaccagaaccgacatgaatactcgaatgggtcctaaactgttacattcgaagatccaatatcaaatcccagccatccgaatcaagaaccgaatgggtatcccaaaaaaactgaaatacaagtatatacccaaaaatatagttatatttacacttgtagtcattcaaatacccaaaattacaatgataaacttgaatatactcccttgtcaatacgagaggtcaaagaagatgatgttaccaaaaaaaaagggatgataacttatcgtattgacgtttcctttccttataataaagcaaagttgacaaatacaaatcataatacaaaaataatttatattagaatctcataatgagataagtagacaatgttatatttacagacttcacacaaaagttttatatgaattttaacactgcgtcatcaaaaccttacttgcaagtccagaattggaccagacgaccagtcaatctttttcatttagaataaatgactatgagcacgatatatgagcacgataccacgattccacgaacatttcttagacatagtaaatgactataactgctttctttctttctttaaataaccaaacaaaataaaaaattaacgaataacatgttgtttattgagagaagggtgatttaggtgaattactgtcttaatatttggttgtactagagtttaattaacattataatgagaagtgaataaacatttaataagatcataactctatgatttcccttacatctatatcatcatcatcatcatcatcatcatcatcatcatcatcatcatgatgtatatatttcttaatatttagccgtaatagagtttaacattctaatggaaaacaaaaaaaaaaacttaacaaaaacgaaatctacttaatcacaccttttatttagggaaacaaatagaattaagattccacacccacgactaagggcttgattggttctccctctttcacccgcaaatgctacgtttgcgggtggtagcggttgttagcgattggcaccaatcatagaaaccgctaaataccgctttggaacgctcgaaatcgccggatttcaaaagctcctttccgcaagcgtttgcggttgcgggcggtagcggttaggttagaaaaaaataattctttttctaattaattaaaataatttattttttaattaattaaaataattttggcttccaccctaatcactattataatatattgtaaccttattctctcaattatgacattcacccaaactgatgaaaatcaaaatcaataatcaaacttaagtatcatctatcttcttatccattcgttagctagtataattttttaagtatttcattgtatcgttgtttttttattttgtattcttttgagttttttgattgaatgcatgtttcgatttgtatcacactacttgatacaatttttggtgatgtaccaaatacataaaggattaagtttttttcttacaaaatttatttatttttgaatttagagttttatttatggttttaattattaagcatgttcaacttttctaatattatcaatttatcataataatatattgtatttttatttctttttatagtaatatattatatttattttggttatttttatttaattactattgtacccgctggtttaccggtcataaaactctcgcaaacgcacccattatcaaacgctcaaccagtcgttgaaaacgcttgatatcgtttgaaaccgcaaccgtccgtttccgcaaactcccgcaaccgcaaccgcagccgccgcgtttaaaccagtcaggccctaaaaacttacaaatgtacagcaaaacacaaagtggtaaaacctcaaccaaattagaccatagctcttacatacctaattaattatcttattgaagagaataaatgcgttaataatttgtcatccattcgtcacttagaagaagcatagaaagggacttatttatgcatccacacgccaacagacatagttctcagcacattcgacataaaatattttaggcgtgtgatgtgattactaatcaaacataacattactttctcaattttttgtttgttaaaagtaatttatataaattatttctgttttctacttaataacattggttctcattttatatgcattgattattgaatacagaaaatatgtatattttacatttttattgactcaactgctactgataaaaaaactgttgaaatattatgagtactaaaaaattattaattaaaaattgattttcatatttttattattaaaattgattgcaattatccacctctgcttccggaattcttgttaaatcgtataaaaactaacaaacaaaataatatccatcagatatatcaattgatatcaatatatcaatatcctatagaaataaattagtttacataaatgcctcgtcaaactaataataaatgaaaatttgcaagagagtttataaagtaataaaaatcagaataatgttaagagaagcttctctcaacactcctactcacgcaatctttcacgcgtctttaaaaccgcgttaaaacgtcacttcaccaaaaaccctatttatatccaactaacactttctcttctcacaatttctcctatttccaaaatcttctatttctctctaaaaaa

SEQ ID NO: 353 - DNA, 3000 bp, Arabidopsis thaliana
gatccaacctagctccggtcagtcattactcgccggcggcggatttaaactgtcgccgaacagagcttacactctccaacttccaccgctctggtccggtcgcttctggggccgccacggttgctcctttgacagatctggccgtggtcgctgcgccaccggagactgtggtggttctttcctctgtaacggagctggcggtgtacctccggctactcttgccgagatcaccctcggtcatgacatggacttttatgacgtcagcctcgttgatgggtatgtctcacttaaaaccaattttttcaattcgggttcggcttaaattttggttcagttataagaaaaaccactatttaatcgtatttttaactatcaatgcaatattatattttaacatattattgaataagtaatatgaatttgaatgaaaaacgattttgtttggccgttaacgttaataaggagtgaataaaagatgagaattcttaaaccgaaccaaatggaaaccggttatagttttcatgaatcaaaccagcctatgaaatagttttttttaaaaaattaaaattaatttataattgtttagcatcttttaaataactaagcatactttattaatattaaacaaactaaactcatcattgtacttaaattagttacagtataagagtataactaaaccgaactttattcataacttaacaaaaccgaaactgaagtgaatttcaaataattttctcttacaaaacctgattgtaccaaaaaagccgaaaccaagcagctctaacatcaatagttttacacatatttgttactcacataatattaattaattatcttgttaatcaatgatgttagatataacttggcgatgtcgataatgccggtgaagggtacgggaaagtgtacctacgctggttgcgtaagcgacctgaaccggatgtgcccggttggtctacaagtccgttcacgtgacgggacacaggtagtagcctgtaaaagcgcatgctctgcgtttaactcaccacgctattgctgtaccggcttgttcggtaacccacagtcatgcaagccaacggcttactctaagatcttcaaggtagcttgccctaaggcttactcatacgcctacgatgacccaactagcattgcgacatgttctaaagctaattatgtcgtcactttttgccctcaccgcggccgttgattaaagggattgacatctatgaataattttgcttgactatttagtacgagatcttctttttgagttatcgacccgtttttttgttttggaatttagtgatttcatcgatttgttacaaagaacatgcattatttatgcgtcttttaaaaaattagtgatgtctaattcgtttgttaagtactgcactttataataaaacaagaaaacagatttataaaaggaaaaaaaaaacatataataccgtattaaaaccgaatagttcaaccaatcttaattttttttccaagaaatataatttgaagatacatttagttaagaatcaaaattcaaaaggaactataggtttaagtttaactagctcaactcatgcttctatgtcatttagaataaaatctcaaaagtattagacagaaaacgagatttggatacgctctagcaacatggcagattattaaatacaaacccattgaattattaccatgcaagtttgacttaattcccatcgtgaagcaaataaatgaataataaaatttcaaagtaattaagtggacattatatacaccagtgccctttttcatcgaataaaccaaaacaaatcaggagaaaaaaaaaagaaaaaaaaatcaagaatatggcctcgaacatttggagagatgtattaaattgggtaataccggctgcgtttatgactcttggattaacatgtctatcgctaatcggtgttgctatttttggaggtgtgcgattggtacggtttgctaccagagatgagaaattcgattttgtgtccgatattgttattgtcttatttcttgcctgtgccaccgttgttttcctctttctcgcctaccatagcttcaaacaagcaattcttaatgtccgacgtaatcgctcccaagatccttcgacggttctaccccctgattaatagtaatttttatcactgtttctagtaacacatagtataaactaaagttaatactcttgtataggcacaagaaacaagaaagcgtatactcgttcatgtcgtttcttgtttagttttcgtacataacagtttgtataataaaactatttaaattatttccggaaatttcataaagatagacatggttcaataaatatcttaaaattcccaatcgttttcaataatatattattcaaatgccacagtcgtaatcttaaacggagaatcaatgtcttttctctcccacttatagtttcagattcccacatagaggtagatattgacatcttactctaacaatatattcttaattttgatacgcattatgtaataataataaataatgctacatgaatacaaactatacaaaaaacacactataatttaataaccaacaaagaaagattaagtagcaagtttagagagttttttttttttcattttgcttttttgttgttgttaattctctgtttttctcttcatacttttctccataacatttttcataattttactagttgatgactctactaccattgatcaacctattaataaaaaaaacttattacaaaataaaactaatagtaattgataacaagagtaattagtgaaggaaaataactcattcagaaatattattagcaggacaaaaaatatcaaatattaatggttaataaaaataggaataaatataaatagttaattaattaaaagccatgaagggtagccatagaaaaagcatcaagcatctcaccaatcaaaagcaaatgatcagaaaaactctataaaaacgtcaaaaacagaaactcaaatcacaaaacaaaaa

SEQ ID NO: 354 - DNA, 3000 bp, Arabidopsis thaliana
gaagagctaattgcaatcttgcttgtcttggtgctcaaaaacctcgtcctcctacttctcctcgacatggtttgaatctctctctctctctcctctcttaattccaatgggaactagctttagggtgattggaaaaatctgatctttttacttgatcaacacgtgaagaagtcaagagtgttgttttacgattcttggtggaaacttgatttccaggaacaggtagattcagatcaccaggatcaggagttggattagttgctccttctcctcagtttcgaggctcttcttcttcctctgcttttgttcatcaacaacaacaacaacacactgctcaattcccatttccttactctacttacgggtaagaatacataatcatcacattaaataacaatccattctgattagtgtgcgtgtgtgtgtgtaagcaaaacttaaaatgcttgtgttttcttcttctgcaggttttctggttattctcaagagggaatgtacccaatggtaagttcattttataaatttgtagagtcgtttccatttcactgataaatctttgaagttcttatgtttgtgttttttgtttgtttgcagaactactacaatcatcatctctatggaggacaacagttttcaccatatatgggacatccatcagcaggatcaacaggaatgttccatggtttttatccctactatcctcaatacaatgcagcacaaagtagcaatcaagctcaagctcaagttcaagctcaacatcaccaaggtttcagctttcaatacactgctcctcctgctcctcctctgctgcaatatccttacttgcctcaccagccacacttcagttctcagcagcaatttagctctcagcaacctcctcctccaatcctctccctcccaacctctctggctctatctttaccttcatcatcatcaccgtcctcttcaacttccacctcaggtttgatttcacaacacaatctacattgaaaaccatttgtcacattgttttgaatcatgcttgattctttgttttgttttgtattagctgcaacaacagcaacaaaaacagtagttataactacagcaacaaagaaagcagaaactgaagctagcagcaaagatggtaatgaagcaatgacaacatcaaccatcaagatagagggttgattcagaactactacaatagccagaagaagggacaaacttcattgtacactaactcatcatcaaatctctccaacaacgttctagaaacattcattcatccatcgtttttaggattctagaatcttaattagtacttaggaggaggaagaagaagaagaaaccatcatcacattctttctttttttttgttgttgtttcaaattgcattttaggtaaaagaatcaagagaaagcattggtggctttcttttagattcttaagaaaacttggattggtgcagaaagcatcatcagattattacattcatttggggaattttatttttcaggttcaaaagaaatgttttatgtcttcttttgaacctaaacaggatttttaagcttcggataagcttaaaatcatttcttttacatttgtaattcttgaaattgttataattcaatcacattgcttcttcttactatatttgttcgtttattatgattataaaatgtttgatcaaccaagaatccgttcatcgatcactttcacctggagttttctcgtgttttataatcataaaaagattgaacctttttgataattattttgaattcgtatgatcattttctgagagtaaaatgattattgtctttggattccaaaggggatcttatgaagacaaaagtaccggtcaaaagaccgttggaatcaaacggatctttttcttcgtcaatggataatatttcacttctactattcttttaacaattttataataaaaaccaaacaaacaaaacatagagaatacataagttatgggcttttgaaaatctaaggcttaaattcttataaagcccattaatttttatatgtgtaagtaagttggccatagaaagcttaaagccttagatatgtaaacacgcaagaatatggtaagttgtttattacgcactgtccacatcatagatcgatagatattctttccacgcaaagcaaagttttattaagatggttctagaattccttcttatccacagaaaatttttatattcaagaaaatccaatttttcatttggagtcgaaatttacgcggccactaacgaaatttgatttaattaaaactagtgggcatttaatatttgaaaataatactatttgttaaatcccaattgaaaatttaataacatttaatataattaacttttttgaaaaaaggaacaaaaaaagccatccaatttgaatgatacatagagcagctgaaaaaaaaaaatctaccttttagaatttattaaatccaaccaaaaatcaaacttagccacacaattacaatagaaacccacgtgtcatccacatgaccactagatattcagacgaatatctccacttccgtagagcgattaggttaatgacacgtgttaaggtggacctgcgaagcagaggaccacctccaccgaatcagccgcgatacagagaaaatcaaaacaatggctcatattaagccacgtcagctcagtgaaggcccgctttgttacacaccgttaattagatttctcaaattgtttatttgctctgagcttatacaacaaagtcttcttctttctctgagaagatattttcgtggttgtgatcgaaagataccaaactaaagagtttaactttcttcttccttcttctttacttcaacatctgatattttctctctctcttttattcagtctgaaacaatatttctcggtagattaagatctaaagctcgttgatctagattcttgtttctatttttgtgtgttttaggctttgttggttttaccaagtgttgtgattcagtttgttttgaggtctgagtct

SEQ ID NO: 355 - DNA, 3000 bp, Arabidopsis thaliana
agctcgaggcgctaaagctccggtatgatatttaaaataaagatgattggtctctatgttttgcttcatcttcaacatttgtttgtcgttgatttttagaaaactagaaagactccaatgacggtagggaatccaaaagaagttcctgagtatgagcttaatccactcgagctgcaagtccgaaaagttgatggcatttcaaaggtttgttgattttcctaattgacaagagccaggtgagattttttgtccgaagtctctcttattctgatgtgtttgtgtttgcttaatttgcagggaacttatcaagttgctaaatggaatggcacgcgagtctcagtaaaaatattcgataaagatagctattcagatcctgaacgagtgtatgcattattcttgaacttctctgtatgattttgtccgtagcatgaagtaatctaacattgtgtttgtctatttccggttcttttttacgagcagaaatgctttcacaaacgaattgactttgctagcaaaagctcggcatccaaatattgttcaatttgttggagccgtcactcaaaatctaccgatgatgattgtagttgagtgtaatccaaaagtaagtacgcattgtttcatacttcatttcagctcattgaatcacaaatgtggcaagcaatcttgtttcattaatcatctcaatttcagggtgatctaagtgtctatcttcaaaagaaaggtcgtctttctccttcaaaagctctgagatttgctcttgatattgctagaggaatgaactacctccatgaatgtaaaccagatccgatcatccactgcgagttaatgccaaagtaagacaaagccgagaacaaattatttaatggcgaaaaaacagtttggataatattttgaaagttttttgtaaggtgccagaaatattttgctagatagaggagggcaattgaagatctctggttttggtttgataaagttgtcaaagattggagaagacagtgcaaaagtagtgaaccacgaagctcaaatcgataagtcaagtaagaaaaaggctgcattttaagttagaaacagattcatatatatatatacaagttagaagcattgttcttgaaagatcctatgcttaccttttgaactgcagattactatatagcacccgaaatttacaaagatgaagtcttcgataaaagggctgatgtgcattcgtttggtgtcattttgtacgaggtagtaacacaaagctttagccttttctttgtaattaaatgtctcggtttcaaactctgcaatgttgttttttggtttcatatgtgaagttgaccgagggagtatctttattccatcctaaaccacctgaagaggttgcagaatcgatttgtatagaaggtaaaagaccaacaatcagaacaaagtcaaagagttaccctccggaattgaaagagtaagcatttcaagatcatcagctattattacatatatgattgttttacaaacattaacatctcaagaatcatatgactatgtaggttgattgaggaatgctggcatccagaaatcagtgtgaggccaatattctctgagattattattcggctcgacaagatagttacaaactgttccaagcagggttggtggaaagacacatttaagttcccttggtaaaaacaaagtttcatcttctttaatctgaatatcaatcctcagttaagtcaaagatttatgttcatcatgttttgtattttcacaggaaatgaaatggaaatattgaatcaatccaatcaaatcttaaacttaaaccccaaagatgaagaaaaaacaagatgagagtgagattttgcagaagactcaagaagattcacaaactcatttgctttgtagaaacagaagatcacttttttgttttcatgtttgtttgtttaatatcataagtttttgagttatttgtaaagttatattttatgataaacatcacttgttcatactgaaattggaagcacattttaatttctagataagagtcttatcataagaggtgccggagggaatggatacaaaaagaaatagtagttgtcggaagtattatctcaagttgaaggcaattatcaaatccaaactaacacttctaataaaataaagttcattttgattcaattggtaaaaaaataaaactttaagattctgatgtaaatttgtgtgtgaagtgaacaatattatttttgataaatgatctaataaaaatcatactggatataaataatacttggtaaaagacattttttttgtttgatgaagaagtaaaagctttaaaaaaaaaaactaatttaattatgaatacaaccaaaaataattatagaaaaataaaatataaaacgatcctttcgtcttggcccttggggttcaagtataatatctgatcgtggattagcccacgtggttacaatcgaaaagatctgggacctagatctgatccaacggtttagaatcactcactcatacaggtgtgagcaaaacaaatatctttatttattctgtcctaaaaagtgatacaaaaaaataagtaaagaaaaatctaaaaccctttctcacgatttatttgccgcatccctaaaacctctcaaatttctccggcgtgattcactttctccggtaaacagcgttcgtcattttcagattcctccgtctactgtaagttatacttcgttattttcttcaatatcttcttcgaattcctcatatttcttaaaatcaaggctttgcatttcgattgcttgcgtcgcttcatttttcaactctattcgagatttcgagaattgtcgtcatttgagagttttctagggtaaatattgtgatttttctcataccgatttcgatttatcgtctgagttttgtttcggttcgtagattttgatagcgatttttcctctttcaaatctatcaggagtgttctcttctgggagatgttcaggtgattcatctttgcacaacaagggatttgacaaa

SEQ ID NO: 356 - DNA, 3000 bp, Arabidopsis thaliana
gtattgatcacaactatccatcatagccgataaatagaagttccaactttgaaggttatcgacccaagtgtaacgttgcaaagctccattcggattcagctgcattcttgtcagcactgaagggttttcaagcttgtaagtgtagtaaacttcttcctccgtgaagacatactcataccgatagatagggttaggttttaggtttggcataccggtgaatcttagaccgttccatggaccagtcctgaagacaacaaccgagtttttcttcaggaaaaactgcggaacaccgtttggatccattttattcgtgtagttaccagttgatggatcgtctattgctctccaagatgtcaagaaccggtttaaaccggttacaaaattaagaccatatttcattcctggaagaaacatatctcctgggtaatctaaactctgccatatgtaatcctgatcatcccctgagtttctcacaactaaattacctgtatcaagaatctgaacaattgggtttcttaggctggctttctgggaagatggtgaggatgatgatgaccagatgatgtgattccggtcattgaagaggcataagctcccattttcagatacttttagggttcctgagagatcgtagagaggagagtctctgttagcaacccaaacaacggtctggagagagattttcttgtaccaaattccgagataacgatttcttgatcctcctggagagaaaaaaccaacctcgaagctcccaccttgcgaaacaatggtgtctccatcttttagagtctggtttgctatgaggatatcagttgcttgtgccaaaagaatcgtcgaaaacagagagatgataagcagatgaagcacattagtggcttccatggccggttctgtggaaccagagagcgtggaaacgaagttggtatataaacaatgatgatagtcagttattttatttgtttaattactggaaatatagagaaaattgtttaagttaggttccatggaatatagtttaatatgtgtaaatgagagagacatggaagagaattgtaatgagttgctgtccagtatcttgcgtcgtgatattatttgctcttaatgtcaaccacaacgtgcctagagattatatatttgtagttttatacgtgttttataggacaaatggtggaatgattcaatggagatgcaaagttacttgtcaattggaactaaataatgcaatttaactaagatataaagaaaacatcaaacaaagtttagtggggagcttctcaatctaaagaaagtaagctcagaaagacagaaaccattgaatattcaaaacaaaaaaacaatccacagcttagcattttgttgaccgactcatataaaactaaaatgttgcgacgggctttctcgaccagacttagttaaaatccgccacgatcagtgttgctgattcagcatgtgggccggcccatggttatctgttagtaaagcttccacgtaatctaagaaaacaaaaaatgagccgcatggattaagaagataatgtacactttcaaatatatgatgaattattttcaattttgtgacaataaaataggttattatcaattctgagacagtttaaatgttacgataccttttatctgtatcttagataaacatgattcaacagatttaatatttcaatagcaaattttatttatgagaggttttaataagagcacaatggtttgtcagcattaagaagacaagctcattaagaggcaagagtaagaccaaagatatcattagccaggaatcatgatttaatgttcgttctttgaacttgactctttttttttttttaatgcattgaataagcattattgaactgcgattttcggttaaatagtacatgaatcatgaaataatgacaatggttatccaataagcaagattttggtttgattatatataaattaaaatagagacatgcaattagagaacgggcagaccaagtagtagaatattatgtcgctgcatttagttttgctgacgatgtctttgaataagggacaccaacatttgatttaatcaaataccatgcatagaaatgtcacataccaagttatagtaaatgttagtcaaacctttgatatttcgtttgtttgaagttgcaacttgcatgcaagtcataactcgaaagtcttttttttttgtttttttgggcacaactaagtcgaaagtctagaaaactgaatgtcatggataagttgatgcattccacagctatttaatttttcaaaactaactgagataaaaacatatttttgaagcaagttataacaaaacttaaactaattacacatttcgtgaactttgacaaaagtaatttgtagtagtaaatatcattaaacatacccatctccaaaaatcgaaatagtaactacaatctatactaaaaaaaactgtgtgatcaggcaaaaccagtatttgaataattccagagtaattttaagtcgagccgaccttaatctttaaagaaaaagaaagaaacatattttcgataatcaatcaaataaacaaactcaagtcacttgccgatgaaagtggtggaaatttcccataaataaacaaaggaacaaacaaacaactcctccatttccattactttactctttctatttcttaatataaacggacgattttaccctccatctctcgccgttttcacactatgagctttccacatccctttacgaagtgacgatattacccctaaaagcgaccttcctcgaagaaaccacataccaacaatctgagagattaatcgcaatttcccagacacgggaccttccctcattaatcttagctggcttccatggatgttccttctcagaaatcccaatttctcttcctttatattctcattcactcctcattctcctcctcaaatcaataacaacgataaaaaaacaaaccttccttaaccagaaccaaatttcagatttttaaacaacataagctcta

SEQ ID NO: 357 - DNA, 3000 bp, Arabidopsis thaliana
agaacgggttttattttgtaattgggttatatggtggatgtatttgaatcaatatttataaaattttaaaatattattaatatgctgttttaacaggggttaaaacttcagttttttaacaattgtctcatggattcgtggtataacgttacttaataacaattataaactgtaaaatataaatattttataaaaataaaatttgcaaattttaatatatattactttcaaaaaataaatcgtcccgcggtataccgcggattaaaatctagttcgttttattcttataacatagggaaatgtaaacattagcatataatttattgctgctaacaagcgaagcatgtttttgtagtttttttttttttgaatgaaacaatcttttgtagtttacaggtacccctttgcttgtaacttctagcaatttttctttctttattgtctgagttttgaaaattattaattagtgcagtgccttctactagactttactaaaagttaagagagcattattgtcaagtcatttctatcgatttcatgctttttctacccatcttatttggtcggtaaacaaaatgcgtagccaaaataatctgtttgattaaaatctcttatatgtttttatcctaatataaattcattgtatccgatacttgatacaaaatctgttatgtaaaacttcatttaacatatagtcaagcaaaagcaataaacgataacgcttgttactctttgtgatactttcatacattttttgtaatgctattttcttggtgatattaatatattataactagtttcattactttgtttttatttttgtgattgataacctactaatggcaaaccttttaagacaaagccaagaactctaattggtgagagaaagctctctaagtctaaaagtaatagtaaacaaatggtaacttacaaaattaactttactcaaactgacatatgcataaataaagtgaaagttataaattttaaatttacctaattttaaagtgttgatattgacctaatttttgttcagttagaaagatagttgataatattttaatcatatacgtatgtaatacatcaactatgttcacgttcacgtacgtatttaaatattcactttcataacaatacttgaatattttactctaaattggtttcgttgacatgcgggaatatagttatcacgataatcatatgacgcaattccatttaaaagtattaatatatttcataacaatgttaaataaataatcaatgataacatcatatatgtatgattggattccccaactatggaatatgattttctttacttgcttgcctaattttaatatcttttaacaactctcggttacctaattttgtaccaattattatgatttatgttaatagttaaccacaagaaaattttgtcttctgatttgcgaaattagttaactttgacttctgatttgcgaaaaaatatcagaaatatataagtgaagaattaaacaaatttgattagtattctcgaagaattgtaatatttactgaatgttttggatctgtttcatttgacccttgatgtaacgattgggacatagtcagccatctcataacccatttcatcatgtacccaattttattaaatatttttttctgacaataatctatcgtttatgatcaaatcttaacatcatttaaaactatttaagttctttaaattgttatggtcaatcgagaagatatatttgtctaattatatcaaatatatcatgtagctgtcgttctttagtataatcccaaacaatattgttctaaatcaaacaattttatttttcaataatttattcaaagaacctacattttaaaaacatacataaaatcaacaaaatatcgtggagaaatgtaataattgaaatttaatgattttatatcaaccacaaaagaccaaacccaacaaagacgatgtcgtgctacttctttgtcctttctcctgccacaagataaaaaatgaacagagacaaacaacgtaccagaaaaaaaagtttaactattcttaaaaatagtttcaactccaatccttaattgttccattaaatggattctgatatttttctctcgtcgctccattagctacttctccggtggatactttagccagcttttctcgagcgtttatccttacgtgccatttcaaaggtctaaatctttctctctctttatacatgtaagaagaatatgattggtctgtgacaagatctaaatgaaagctgaagagaaacctttcttgggttctgtcttttttcctttctacttctgaatccaagtaaaccaaggtttttagttcttgatataaaaagtaaaaaaaaaattgtgtaaaattggtcgtcactttttcacttcgggtgatatgaagatttttgctcctttgtctcaaatttagaaatttttatcttatcaaacttatttttgaagcaaatctatggagattaagagtgtttgcttcttttagccttttaggtgttcatattaatatatagtattaagcaacaacatgctgagaaagttctcattttttttgtttcttgttagttttccctgaaaaagcaaaagagaagaatcttggaatcttgcaacttgttttacatttccttattaagaaatatctctagatgtgttttctttaaacagaaactctctttcccttcaagtcaaaatcatgtacatcaaagataaatcttagaagcttgtttcaatggaattccatgtcagacttatgaatattccacttgaagttcaatttttgttgttgtttttcaaagtgtctagattctcaacactatgactcatcttcttacttttaagatttaacctctgttttatgatctccttgtagcactatcaaagtttctaaagaagttttggtttcttgttttttaaggatcatctgaagcttaaggagaaagtttctcgttgttgcttgatatattaatcttttggggtatttaaaag

SEQ ID NO: 358 - DNA, 3000 bp, Arabidopsis thaliana
gtgatccaagtgaagacgagatgaaaagttcgcaacacccttatgatatactcggtttctacaaatccgtgtataacatgcagcagtgcgaaattatcgaactggatcatagagatgatgaggttgagagtgatggatttagagaaattagggagagagaagggattcctgatttggaacctgaaagtgattataatagtctgataaggaagaataaaaagaagaataaaaagaagaagaagaagaagaatgttagagaaagctcttctgttgcaagtgaaattgataagcgagatgttgaagcgaatacttgtaatggtcaagttgcagatgagactgataattctaatgaagcttgtgcgcaagagacagaaaacactccagagattgttacggaagaagtgacgagatcagatgaggaagttgaagtagtggcaagatcagatgaggaagtttctgatgaagcgtatgagtcttcttcttcttgtttttcggaatcttctggttcgggtttgacggatctaaggaaggtagtggaaaggatcaatagtatatgcgggaaagctgcgggtaatagtgaagtctctgagttgcttgaagtaagcagagttgtttatcatcaacctttaggatctcaattcaagggatttgcttcaagagtaattggtagttccgggactacgactcgtgatttggttttaaagcgccgttttcgcttagatgatctcgctgtttcactctctatgacattagagaagctttatatgtgggaaaagaagcttcacgcagaagttacagctgaagaaaagcttagggttgcttatgaaaaagcgtacaagattctgaacaatcttgatcaaaacggagcagaatctagtgagctttacgaggcggaaactttggttaaactccatttatctaaggttaatgtttcggttcgagcggttgaatcgatttcgatgagaattcataagataagagacgaagagctttcgtttcaagtgattgagatcattaacggattcaaaacaatgtggagattcttggcgaaatgtcaccataagcagtttcgagtgattgcgagaagcaagtcttgtgttcacattgttgaaaacggatcgagctccaggaaagccacgcagcaagtcgaaaaacagattagaagatacagagaatctttgaaaggttacattgatgcacacagaggtttcgttaagcttttaaacgaatggcttaaccgaatcatcatggaggacgatgaaaccgagactgaagctcctgagatatttagggtttgcagcgagtggttaagagagattgagaatgtggatacgattaaagtgttgagtgttgttgaagaaatgagattaagatttcaagggttagggtttaagcaagtagaggaagagaaacagaggatgagaacagagagattgtctaaggagttagagaagaagacgaaggagttggaggagattcggggaacgagaggttctagtccgacgtcgaatatggttgaaccggagttgttgtttttgagagagagtgtgacgcaagaaacagaaaaacatgagagattgataagagagttaaacgacgccgtatcgatgagtttgcaagagtgtatggttcctgtctttgaggctttgggagatttttgttttgctaattttaaagcatatcagaacattgtaatcgttaccacataaactctatgattgcgtcaatcataaaaataaatatgtataggaaattaaataaagaatttcatcagatttcgtatattattatatcaacatattagctttgaatgtttgcgaaagttcttcattttctggcgagattatcagattgtaagacttttactttgatcagtttatgcttcattgcttgcatctgcttaaaatttccggttattgatcatgaaccgggttttttttttgtatatgacaattatctaaattaagtgttcgaaacattttgaattttaaatatatgttcaatcggtcccgaaagatcttgatctaggtagagatatacttaattaaaatcgatgaatgaccatgtcaataaatcaagattcaatgttctttcgacgaattctgttcattttgcggttgggatcatgcattcatttaaaataaaccattattgaatacgttatggataatgatagtgattaattatccaatgaggaagagatttggttggattgttttggagagtaataataaaaaataaaggcatgcaatagaaggggcagaccaagtggaatattctgtctaccacaacgaagtttcaatcaaagatatcagaggttaatgtcttccaataagcgaccaaaaatcttgattaataattaattatatcgcccaaagtcactatgaacttgtacacgtgttattttggagacttttctcacctaaatacatcgagatcgccttgttagttggtacttggtaaacattatgctctaatggctttggttgttattgacgaacatacaatgtaatgaatattttctcaattgagttgtttcatttctaacaaaactagaaactaaaacaaggaaggcgatgtttctcacatgaaatttacatacacgcaatgaaaaccaaaccgactaaattttgtgtttttttcagggtgatttttaagaacattccttaatcaatgggatctaaaaaagtcacttgcctaagaaagtcaccgaaacttcacattcaaagtaactttatcctcttctcagcttttcacattatgaacctcccgtgggaacaaagacatttatacccttacgtgagcttccaagaagaaaccaacaatttttaagatttttccccattacatgtagattagttggcttcaagtttctatggatgttccttctcggaaatccataattctcttcctttatatataaaacttactcacaacacaaaacccatctctcaaaacaatcaatttctctcaaactgttttactttttcttcttttgta

SEQ ID NO: 359 - DNA, 3000 bp, Arabidopsis thaliana
gccgatgtaaacacataatactgaagaagccctcacctggaccagtatgcttgagtttgaagttctcatcagcaaacttctcaccatagatagattctcctcccattccatttccatgtgtaaaatcgcctccttggagcataaagcttggtatgatcctatgaaatgaactccccttgtaatggagcgccttcccattcttacctattcctttctcccctgtgagtataaagtttaagtaagcttttcatatcaaggtagataaactgctgtgctggcagagaaaagttaacagataatcgattggcataggatgagaatgagcaatatattgttttcttaccagtgcataaagctcggaaattctctacagttttggggactgtcttgccaaatagacccatgacaatacgacctggacaaaaatcatcaatcgatatgagatgttttcaggggacaagacaagaagaaaccacaaagcatttcatgcagtctaacatatatcatcataagataaaactcaggaacaaggtcataccagctgctttcccatcaatttcaacatcaaaataaaccttgtgtgtgatctcctttaagttttccttagactttttggcctggaacatgaaaccaaacatccagaaatcaatataaacactagatcacaaccgtttcataatatatacatcatcccaacacatttagacacaaattaggcgcacttcatgcagtaactagctctctagtgttgaatctaatcatatgttaaggatcaaattcagattttccaaacaaccatatattattaactccagtttctttaatcaaataagtccataattcaacagaactctttcggcttcaaatctcaaacactatatgactcatgatgaacgtataaaggtttgttccctgatcctaggagaaattacccgaatcgtccgcgattaagatgattgaaactaatatcagaaacatgtcacatcaaacaccgaatcaaataataatcaacatgaagacctaagacaattatataccgttaaccaatcgcaaccaaattggtattatctagatcgtgcaacaatctaagaactcaatcataaagctttgcagaaatcgatcgactagtgagaaggaaacacacgaatatacctgaatagcgcttagtgtaccgagaagaagaagactccatagaagcagcgtcactgagctcgccatcttgtcgcaccgtgctaaagtgtttctccacagtccctttttttttcccttgtccaccgctatttctcaccaaagccacgtcaatatccaattaaattccgccacctggcttgtagcgtgtacaattgtaattgggcccggatcgttgtagaaccgtaatgggctaatgagtggtttggttacagcccattaatctttgtgaattctatgattctttattgttgttaattaagaaatgataataatagtaattcagagttggtaaccctaatggaagaaatggctcatggctggatcggatacccaaaagtcatttttaattcttagtcaaaaagactcaacatcaataccataagcatgtcacattactcttgttccagctaatattaatatggttacttaactttataagtggttagttaaatattaattgtcagtatcattttaattaagcacgtttccatccatattaagaattcgatgacatttaaatactgtcaactttcctgggccagtcttccagtacattttattttgctacatcattgataatattttactattagtaaaaagaaagggtaaaaagggcgagattagtacttaacttttggcctaaaagatggatttggaaagacaacagacctgcagctgcaccaccaatatagccgaacactttatttgttgtcgctttgctattgcaacatatctaatgttatctgtttttttttttcttttggccgacatctgaagtatttcaaaaattaaattgaatttcgcatttcttgttttttcctacataaaacatcatttaatagataattaaagaaattcaaccactgataaatagtgcaaaaatacaaattgttacaaacatcaaataatttgggggaaaaataattcccaagcatgctataaaataaaatggaaatatatgaattaattttactatgaataacaaaacaatatatttttacacttttggtctaaaagagacatcatgaataaccatgatgttatgttcaaaacagatccaaagctttcaaaactctacagtttggcccgccactcaatcctatcaacaagatattcaaacaccaacaagaaattatgacctttagctttcgagagtgtaatcttgcggtagataattgtctatcagtatagtaacaaaacttacaacaatagacgatattaatcttggagttatttcaatggaagaatgtattctgttgagagaagaaaaacaaagacaatacaaaacacaacaaattgcaaaagatttagatctgcatctgccccaccaatgtagccagaccagttctttattttgttgctttgccatttcaacatatctaatttttttttctcaatagtctcgattttgtgttcacacttcacacaaaaatgaaaatgaaaatatcttttgtagtatgttatttatggggagggacaaaaacaatgaacacctggcgatataatctcagtaactactatttttactcatcccttttaaattagtcaattttttccctggttttaaaattaacgaggagactaatttgtaaattattacaaaaaacgagattcagtaaaaaaaagtttttgtttttgtatttttgtgtgttcaggtgtgagcgtgtaagagaggaggtttgacgaggttttctctgaaatggtttcgaagttttaaaataatattaaaactcaggaacaatccgagtatttatgtagaatcagaatcacattcttggatctgaacaagacgacgatacatacacaaac

SEQ ID NO: 360 - DNA, 3000 bp, Arabidopsis thaliana
atgctcagaaatttcaactgaatgctagcacaagtgacatgtcaacatcatatttcgggggcaagtccccgttcccgcaactggaccaattcatagaatccactgcttccacggggaatgtcccaggttgcatttaatctttgttcaacttgttgtgttgtggagagatctcaattctcatcttcttaaaatacatatgctgtgatatttaggtaagatacgctgctggtactggttctcagaagatggcctgattgtgtacagtatgttaagaaacagatattgcgaacggattggcagggaacataaaagcaatcatggtaccatctgctctcaacccatttatgatatacgagtatcgagtatgttatgtaatctctgcaccaaataacatttttttatgcctaacatttgttcaaacaaactatgttgttttagtgatgtacatcgttgatctcagaaggggaatctattatcagaaatgctacgatccagactgccgaggtgtgtatacgatccttactcattgtcttggcaaacaatatgaaagcaaaatcttgttcctaaaaaaaccaactctgtctgcagattatcggtctccaatacgtccagttccagatagttaccttcctgaagatatggtctactatcaaggagctacacagaatctctgtgacaatctttactctgaaggagaatgtcacgttgataaagaatgcgatccagatagtgctgctagcagaggctcatggtggcttgaagcagttaaagtcgcagatgatcttgaaagcaaacccaagacacttgaacctcttacctgggtcagttgacttattgttattgacttaagactctgtctaatttctcgagaatattataaagaaaaagctttggctcacaggaaaattacgaggaagatgatgactggtgggtagcagctgcagaagagtcactaaaacaaatcgcatctctaagtccttccccaaaatgcccttgatttagacatctacctaagtcaagaccaatctgggttcgtcttcttcccttttctctatttaaaaccaccatcgttccctaaatcaatgaatctctcaaaattcaatggctgcattaccagtattcataccagcagagtcatttccatcgatcctctcacatgaaaccttgatcaatcactttcggaccaatcttccgaaacattcatcaacaatcacaagccctgtccggcaaaactacaccgtttcatcaccttcctctctcctcctcatgccttcttggtcatcttcttcttctctcccttacatgggcgtcaagctcgtgacctatttccctcataactcttctcagaacttacctggcatccatggatcctacacactctttagctccactacaggccaaaccttagctacaatggatggtactgttttaaccctttaccgtacttcctctgtttcaggcttaggatccaaaatcctagctagagacgatagtcaagtgctgatcatggttggttccggtgctctcgcaccacacctgatcaaatcccatctagctgcgaaaccaagcttgagaagagtgatcatatggaacagaactccacaaagggctcaggagttagctgaaaccctctccaaggatcctcaacacaaggagatttcattcgatagccacgattcgctagatcaaatcattcctctaggagatattataagctgtgcaacaaactcaactgttccattggtcaaaggtgagttcttgaaacccggaactcatcttgaccttgttggatcgtttagccatgaaatgaaggaatgtgacgacaatgcgatacagagagggagtgtgtttgtcgataatgacactgcgatgatagaagcaggagagctcgcgggagcgtttgagagaggagtgattaagagagaagacatttgtgggaatttggtggagttgatcaaaggtgacaaagaagggagaaagagttcaacagacataacagtgtttaagtccgtcggttcgggtaccgtagatctcttaaccgcacaacttgttcacgagacttacctcagccgttgttaagcagtgtgaatgaatcttgtttgatcattgcgtttgcgaatatttcacattgttatttaaacgaaataaattattgatatggacctatggttttgttgttgtatagatggagttttattgccaaattttggattggttgaattctgatcgcaggtgaagcaagttgactttttgctgaactccgttcaggttttgctgatagccggtttggttagttgtccttctcaaattaactaattgaaaatgatatactcctaaatttcctattaactaattaaaattagtagctggagatgtgaatggaaattgattagtaccaatgtaaaaacggacaaattagtatgaaattgtaaaagcggacaaattcgtttactcgcatctgattttgtatgtaaacagtgttctctaatagtggcttcatgaatctctctaataaaatatgacttgttgacaaccacaaaaaatggcattgtgctaattagatccaatccaactatctaagtatacatatcactgacttatctttttttttgggatcaaaatcactgaattatctaaaatacatatttttggatttatatttgaaccaaacaaaaagacaggcgtatataaaagagactaatcaatcaattagtcatcgaagccgtcttagctcagtggtagagcgcgtggcttttaaccacgtggccgtgggttcgatccccacagacggcgaagtagttaattttatatttgatgcttttttttggggccaatcgggttttcggcccattaattaaaggcggtgataggaaaaaaaaacaaaaaagcaaatgacctaattgagtcagcttcttcttccctcttctctcttcacttagaagaaccgcaaagaaaagaccttattcacacaggtcgtctttgcgaagctcatcgtcgacg

SEQ ID NO: 361 - DNA, 3000 bp, Arabidopsis thaliana
ttttgagcttaagattctataggacaacatgatgaagcatgtaaacaaagcggacccctcataccacccacacacttactatcatcaataaaatcaccaaaatggtcaacatgatgttgacttttttgtttctcatgatgtttttggactcatcaaattaatgtccattctaaagaatttatttgggagattctatcattttcctctagctcacgtgtgtaatcatcagcgaaaccgacgcatggttttctatttttttcttccattactaaatccacaacctttattaacaaaaagagttataactaattagttgctttcaaaatatcaagttttgtcctaactatcactctgtatctgctcacgtgtattttatataactaaggatcagtgccagagaaggagattagcttcagagacgcacttaaggctgcaccacaggctacggcagccggtggtggtgcttccatggaggaaggagccgccggaaaagacacaactccggtggctgcgattggcaagcaagaaatgccaagtgcaattgtaatgatgcgcctcatactaacagtcgtgggccgcaagctttctcgaaaccctaacacttattccagcctcttaggtcttgtctggtcacttatatccttcaagtgagtcaaaaaataactcaaatatcaaaatttcaactataatcattgaatttgtttgttatataactttaactcatattttattttgctaaataatgagcagatggaatataccgatgccaaatatagtggatttctcgataaagatcatttcagatgcaggtcttgggatggctatgtttagtttaggtatgaacatgttcttataaacctgcataataaataaaattatgtataacgtattctaacaaaattaaactataggcctgtttatggcgctgcagccaaagatgatcccttgtggggcgaaaaaggcaacaatggggatgttgatcaggttcatctcaggtcctcttttcatggctggtgcttcccttcttgtcggattaagaggttctaggttacatgctgctatcgtacaggtaaactattcagagtttaccttgatttggcccatatatattattgttggaaaattaaagaaaacatacttggtgatggagaaagtgtttaagattttgggagtgaattaggaagtttaacatatagaagggactaattagttaaaaaaaaatgaaggatagatatgttcatagctttcaaaagtacaaatatctatctcatataaacctaatatagtctaccattatatctagacttatatgttacaaagtatctagatattatgaaaatatctagatattttacatgatgcaattctcctgtattagtctaaggaggtattaatattttaagatggttctaaagagactctttaacttgtttcaagttttgcgtttggtccaagaaattaatgatacctggatcattgacacataattataactaatccaaaatcaagttaaatatttcaaaatataaattacccgtggctataatttaaacttcgtttcttataaaagttttcgattaacttatagtagagatatgtacatctaaatttgatgaagccgatatgttcttttaggctgctctaccgcaagggatagtaccatttgtgtttgcgagggagtacaatttgcatccagacctactcagtacattgtgagtctcttgctcttctttttgttgttcttcatttacatttacggttgaacgtttcaaaatgcggtattatggtttatgtgaaatctctgttcttggtgattttttgttttgttttcagggttatctttgggatgatagtatctttaccagtaactattttgtactacgtcctcttgggcctatgattcacacaacacactgaagaaaaagattacaccggagaaattaaatgatctatgaataaagaggtctggaaatagagaaatgtgagctcttaagagttgttcttgaggagcttgtgagaaagattaattaacggttaattacattgttgaatcaaattactggtaaatggttaggtgaataatttaattttatgtatttgatatccaacattgatcgacgtacgtacgtagtgaggtagaggcttaggttaggaatcaatcgtgaatactatttcaacgttgattcccgcgagctgaatattttttgtgatgtatagtaaaacgcatatgattataggaatcatcataaagattcttgtcatgaagaacaatattaaaccaaattatgcattacgagcaaaataattatacaaaaatactgataattataacttgggtcattgtattttctgtgtaatgtctactatcccttaattagtcggtttaaatcaggaaaaagtataattaatgacactcataattgtatcgttaagacttgaaagtgacggccaagaatacaattaagagccaattagtgatctttcataactttaaaaatctcacaaaagtagaaaaaaaaaattccaacttgatgaccaagaataatactattaaagagctatttaagatgaaaccgcccgaaaccaaaagcattcgatgggtacaccgattactgcttttagcaacaccacggcgtgaccatcaagactaattaactaagaccacattttaaaaaaactattaataattactacaatttgtaattaaaaagatcaacgagaaatgccacgtggacgaatactagcaacgccaagtggaaagagcgttcgagagaacaaggcaaaaccaaatacgcccctagtattctacagatgtcgactggataattacaaaagatttcaataaacagtactaattaatttctagtggtgagtttttgtaaatatctacttcttccaattaccagctgctatataaatccccttctctgtttctcttttcttacatcacaatcacacaaaactaacaaaagatcaaaagcaagttcttcactgttgata

SEQ ID NO: 362 - DNA, 3000 bp, Arabidopsis thaliana
gtagtttattagcaaagagccattgacgacaccagcggtgaagtatgaaacatcaattttaatagcaaggcatgccatccttttctatcacatattttatcataaaaaatcgtgggaattgaaccgttacatatagacatagatttgacagcccaatcacatatcacagacacgaatacatataactagctaggttccctcaactattcatttgacttctgaaaaatggtcatctctcgagttctagttaatacaagcctatgatcataattagggcatatggactataatccatcagttgtattctgtctatggtagtcaaattgtaaggcctgatctttgggttttgcaaactatttactagaattgtctagcattttttcctatgatgtaggataaatcacccttataaagggattaaaacgtttcagaaacgtttggaaactaaactacaaagggattcagtaatttattcaatgcttatttcgaacaatgatgatagcattaagatcttacagccgattaaatttgcgcaaacaatgatgatagcattaagtttttaatcgatatgtcttcgatttacattgtctattgtatacttacaaacttttatgccatatgaactgttttcttatattaaagattgaaaatgttttatggggaagaagattacatgattggataggaatcttgaatatctctacaaaaacggccttgtttctaatcaatctatgccaaagtcaatccgttttttataacccaaattagctataaaacctactgctatataaactggatgcaacgggacaaccaaatgcattatgtagttttccacttatcgaagaaatgaaattgataatgtgagacttctgtagcagaaagctcatcatgatcaagccttataaaacatttcaaaatctaattcataatgaaaatttgcctagccatttaactagctagggccattaggcccaatgtccaaatagcctgaacgctgggaaaaagtggggctttcggaacagaacaaataaaatttgacgcactttattgtgttgcaagctacttcttgaagtatatattttgattctcgaaacgtcttcagttctgtacaaatttaaatattctattgaaaaagaaatcttggtcgtcgtcgtcgaatcggatacgttaacgttacgacatacgagtcaccattagggccgtagacgaaatactaggagacgcatgaaggtcacgtgtatcaccgttgcagcacataagttttcacctctcagtattgaacatgcgccgtatttcaatttcaagcttataagaatattattttctgttttgtctcgtcacgtagaagaacactcaacacaacgggtcatataaaaacaatcaattgaccaattgaaacacttaccattagctttactaaaacaaaaagtgctacagctcaattatttcgacgtactttttttttttttttttttggtcttttgtggcctatttcgacgttctttaaaaccacgatcatagtggtttgggatatagtaattaatttcatgtgtttaaccaaaaggtaggaaaagtaattaattattagttgttgagaaatcaagttgcaaaggagattaccggcgactccgttggtttatgaaacaaacaatgagacggtttagaatgacggtggccccaatattttaggtctgctcatattattttgaatgatttaattttttttatttaaataaggtacccttatatacataaatgatttaatttagtaaaagcttttgtttatattgcttttatacaagtttttgggtatgactattttaacctcaatcctcaaaactataaaatctattattgcacgcttggattttatatatatatattcaatctataagaactaaaaaataaaagtgatcatagtcaaataatttttgcataaatacttaatattgctacccaaaaaaaagaaaattgcataaatttatgtataattacattatgaaaaattattgatatgttgatatacagttttctaggaaatatcaatatgaaaagaaaaaaagaaaaaaaaacattgtaagctatttcccttgaattacactatatgtatgtgtgacagtatatatgtgtgagcttaatcatataattaccgtaacatcactattgatcttgaaagttacgacgacaaaaacaagattccatcatagatctacgtgtatcttttgtgtgattagtatataaccaaagcgattaagtgaatttaaaatttgtagatatttcttacttaactgattatactataagaagcaaaccccaaaaccatctgcatctcaacgacgataatcgtccgaatatgtttttctaatagagtttgctgaccaaatgcaaatggcatcacgtctcttgccgtttgacgctagcaattacacttcttcattgaaactttaaaagtgaacccaaagaattaactcaataataactgatgagtatacaaattattgtttccggctaaaaacctgaaattaactcaaatttggaatggggatattataactttgttcccacgtataacaaattagttcataattaagaggagaatcacaaaaataactgatgtattgatgttcaattttggaaaattaagatatttccaatggtaataatctgttacagccttactgggagtagtatgatactaaaacagtaaatgcattttagaccgacataaacaataattaagaagaagaatgtttgggtcaaatctcaaagttagatattatttttttgctttttgcacaagaaaacagaaaccaaaaaccactagtcaaaaaaccacccatgtattcctcctagtctctaatccaacaactatataaaaacctctcccattctcattttgttactcatcccaaaaataaaaagagtatatctctcacacacatacacaaacttgacagttttttaatttctctgttagtgaactcaaaccttcccatttcc

SEQ ID NO: 363 - DNA, 3000 bp, Arabidopsis thaliana
tatctttccaacaacaattgaatttttaaaaatattagataacttaccgtgataaattccaaaacaaaagtcagtcaccgtgataaatataatccgattagtccatgtaatgtctaattgtattatatcatttgataatgcctgttggagtattagagtagataaaataacatacatagctggaattttttcttaatgttgatctctttaatataatatagtgtaaaagttagttatttagtagtcaaatgttaaattaaatagttcacgatggaaaactggaagaagacgtcaaaatatactattgacttttttgtgcgaaaatatactattgactaagaaaactaaaaagtggtatgaaagacaagtcagagcattattattgcttgtctcttaaattagttcttaggttaagaacatctcattctatctcttatataagagatagaatgagatgtttttagtaatcaattacaaaaaaaaatcttaagaactaatataagagacaaccaataatgatgctctcagaagcctatttatattttcaattagaatgtccggtttaagagttaagacccttgcacgcgtggcctgagcacgccaacattgcacaagcatacgagtttactatatgaaaagaaaagtcaattatgtagtaagtgaaaataaaatctcatagaaacgatttgtcttctttaacaacaaaattaataaaaccgatttgtcttgtgaaaaattaaaagagatgtttctaggcttctagcagagacgtggtaaacactagggttttagataacactgtaggaaaattaattgggttttggttaatggttacacagctaattcacccttattttttctaagaggaagaaagagtaaaaaattagtaaatttgagaaacgttagcatcgtaacaccaaatgactcgactactctcgtgcttcaccgcatagtatttaattatcttatttgtatcaacacaatgcatgagttctgtatatatgagtaataaacaaacgtggaatatactttcatgagatgcaaagtggcagaggcatcaatgtaggtaggtaagttctctgaggctgcaagaagaatctctgttttttattttaagcagagctttatatatagacgacgccaatggatggctctaagacagtaagacctctgacactcaaatattactggagtatggttcctgataccatattctatattctacaatcttttaacttttactaaaggaacaattcaaaaaaaaaaaaagtaagaaaaattgttatatcatataatgttttcatattcataattatttattcagctattagtttaaaaatggattttttaattaatatattatttgatattgtatatgaaataagaggttcgaaactaaatcaagacgaaaaccaacttatataaaatcaagattaaataatcgcattccattattagacgtacaccagaatcataatcgtatgaaatcaattacaaacaattgatgagaaaaggaatctataattcttcaaggaataatcaaacatggaaggaagaacaaagaaagcatcccatgtggtggggtggaaaataattcaagtgtccattaatatctctctctgtaaggctataaccaatgaataacactgtcaatccggtacgaatacgatcacatcaaaaagtgaaaaatgatgcttaaaccaactaccattaattccttttttggcgtcaacattgatttttcaatttattaagattttttttactaatgtaacatagatgaaagtgaggttttctcgttacaataaaaaaaaaagaagctacatagccagtaagccagagaactaaacgtttcttgtacatgcatgttgcatgagaactcttctagtgagagaactcttggcccaaacaatcaattttttgaaatattaaattaagcttacaaatttgcaagagtgatgattgctatattgcataagaggtatttaacttggatttttttaaaaaaaaaaacaaattgggacgaaaatgtagtctttctttttttgtgtgtgtaaagattaatatgttagaagaatagcttatatattgctaaaaaaaataaaaatgaatagcttatatataaaatagcaaaatcaagaaaacgacattacttttaagctgaatagatatgaattttttgaaatgccaaaagttattatataatagatgaacaaagttttttttaaaatatagttataattttaaaacgtacgggataaattaaaagatcactttttcacgttttctttttttaacaaaacttttgttagataatctgaaatattactcattatttcccatattctattaagtatttgtgaataaattgtatacagctaaacacacataaattacaaatttattgatttaatatactttactactttggttaaaaagtaaacatattcaaattcctttatttcttctactttggagctgcattaaacaacttccttgaataattacgtaattaaaaacaaattaccaaatatttagtcaaaaaataatttagtgaatatatcaaaaataaaaaataaaggaaagtcggacgatactaacaaaattattaaaggaagatgaatttctctttccttgtgcgcaaaatagcaacaagtctccgcgtttcctctctttctctctttcccttatttaaacacacttcgtcttctacctctaaacaatctcaccttctctctccctctctataacaaacattaatacacacaccaaaaaaaaacctgtttatgtctcaaagatctctgattcctcattcttcttctatagcttttggtctccattctcatctcttaatctccagtgagatcagctccaattctaactggtctctctaaataaaaaacagaaataaaaatccaacctttttcaattttcgttcaattttcccggaaaaaaaagcgatccttttgatttttcgatttctccaagtaacaattcaaa

SEQ ID NO: 364 - DNA, 3000 bp, Arabidopsis thaliana
taccgtcgtttcaccttatctatcatgttttgatatgggggaatgtctcttttatttgcattttaaactttataatctttgtgttattttttatatatttggtttgatttaaatgaataaaaacaagtctttatctaaacacaaaaggacccaaaaatggtcaaatttgggtaggtctaagagtgggttgtcaatctccaactaaccatgttttgatgtcccaacaagctcttgccttcagatttgctagtcctaattattctttgaaattataattcataataactaatgacctaccaacttcatcatcttccactaatctaccgagtaacatgttaggatttagccaaatgtcatttccttagttttggttacaaccacaataaaaattattatagtaccctatatatatattatcattcaaccgtagaacatgcacaacgttgacaaaataccccaaaaatgtcatttcctttgttttactcttattttctaaacaggtgattttggattaaaggttacttaattttggattttattataatcgtcatgtaaattttctaatggtcaagagaagaagacttcaacgagaaacgacttttttggcattgaccaacaaaaaagtgccactaaactaccatcatgggagtaattacaaaagctttgcgtagtcaaacattcggacatcaaagacaaaaagtacacaatataacaattttaggtggaaaaaacaaccaaaaacaaaaatttgacgcgttttcttgttaacaggagtattggttaatacttaatagctttaactatgcattgtaaaaataaatcataaaaggatcaatgacgatcttgattgtttagaaaaaaaaattatttcaaaaagatttattttttaggttttcaatgcaatagttattagttataattgataaattgtaaactttaatacaaattattgaatatcattggtttagagttattgaaaattgtaaatcacaaagaacaatacatttaaaaacaacatttaatatgttttcttaatatttgtgtttttcctaaaagattaaacaaaaaagaacagaaagaatatgaaataagaaaaaatgcactagctttttttgtttgagttaaaaaggactatatttattaagaggtaaatagtatatcatttttacatgttttaacgctatgtaaacgtgattaagttacttgttatcaaataatcaaaattttatgattttcatgtttttgaaaaatgatattgccgtatactgtgaatgtgtaaaaatataggtgaaaaaaacaaacgccaacaatctattatgcttaataatgactcatatataagaatagtttgctcatttcttatgctttgttaattgttgttgtatgctaagagaggattgatgtttctagtgatgtgctaggaatgttctcatgtataggatgtatcggatcttgaggttaagaaatagagattcacatttccattcttaacacaacataaataaggattaaggctaatgaaaaagagttcacatattacacattttactaattaatcatggtgattagataaaggtaacaactaaaagtcattttaaccgcactcaatattacgagcttgttagaacactgtaacacaagtgttctcttccagtttatcaatggaggaaactggtaaaatcccatggacgatcttcttctctcatcctctgttctcttgtttcatttcactctacactatatttcttctttatttccctcaagattctcttcgaattcttatttcccatgtccctctcctcatcggagctttcttaatctcctgcctccatctcgggtcgacccggaaatccattgcccgacccggaagcaatgaggattcgataggacctgaactcaaaacgggtctcggtttaaacccggattttatggaatggaactttaaattgggagctccattggaagttattcacaaagaagaagaagaacagtcgatgacgggtgtaaaagatccgacccggttcgtgatgatcaagaggtttccatcgttatcgatgtttaacccggaatctgattccgaattggaccgcgatttcccggttatgagtgaaaatgatccaacccggttcgtgaggctggaaaggtcaattaaaccggaatctgatatggattacgactccgaattggacaacaatttggttattgatgtaaaagatcgaactcggttcgtgaaggtggagatattcccatcgttgtcaatctttaaaccggattcgaattccggttcgccggagaaattgcgttgtatatacgaaatcaaaacggaaacgctttttgtagttttatattcctggagaacaatattctaacaacttgttttggcagcaatattctgatttctgagtataatttgattcgtcaagtaaaatctaattttataattctcaacaaacaaactcgaatttgatttctctaatgtgtaatgtcgtcacgatttacgtataacatattaaaagttgtcgacaaagaaaatgaaatacatttccaccaaatataataagtaacaacatggtcagattcagagaggacgatctggcttggccaccaagattgtttgacaagtatttatttaactactatactttctcttccacaatattaataatgttttaaatgtcattattaatacgtgacgaaactgtagctctgaaataaatatattaacaaaacaaataaatattctcaaccaatcataacctcgtatttgtttttgtttccatttaaattttattttgactcgacttttacacgcatgccacgtggtcaaccaaaacgtatgacaaactctacttctccaccgtcacaatcatctcctggccccctctagatctctctctcttttcctccttagattaaaatttctccaggtttcttggcgttactgtgtgaaaaattcttcttcttcttcttctcagcgattgaatcgaaccaagagcgaaa

SEQ ID NO: 365 - DNA, 3000 bp, Arabidopsis thaliana
cagcttcttccttatctataaggtcatctttgttatctgcaatatctccattcccatcttcaggagatctggcacgattagataatagtgattccccgattggtatagtaactggttctggacccaccagtaaagtttcctcaggagtattttgtccattttcttctcctaatctcaaatcggaatcactctcatcttcactatcatatacaatggaagcaggatgacattcatctttgtgaccttgccgccagtgaatgatttgacatttcccggaactggaaaaaaaataacaaaaacgaaacaactatcactaagatatgtaggtaacgaaatttcacatgcgctaaggggaaaaggttgaaaatttgatagacattatagtacatttcttaagctatctaattgaaataaattcctcagcagcacatagttagttactcacagataagccatgaatcaaatactaaacttcctcccaagctaactaattacccataattttgttaacatagaaaaagaagtcaattttcttaaatctctgatccagtatcgctaaagttacagaactaacttatattctttgcctactaatcactccaattcatcacgtctcagcagagagtgcagcagatgcaatcataactctaagatcatacaacgtaatttggacatggagaaagtgagagaatttttgcataccaatatcgaacggctttgcagcgagagcaacgagtcgtggcaagacaatagcaaacaggacaatggaagacattagagacggcaacagaagagaactcaacagaggcctctagctcagccctggcagcctcttcagaagcatgaataagaagtcttctaatctcctcccttctttgggcagcgaccctccatttgtgacgaacaaagagaccgatcaaaggtaaaacaagagagaccacaaggactagactagaaatccctagatccaaaacaaggagcatttatcctccaccagatgcacaaacaattggaaataaatctgagcaccaaccatagatttcaccggcgaataagccgggaacagaggtgacagtgaggatcagtccggcgatttagcacatgcagagagagcgagagagagaagccaggaatcgatggaagttataattttttcgctggtgggtaagcttccaaaatgatgacccaagaaaatccaaagatgagaaggaataaagaaaaccctagagagcacaagttgggttttctattgttctctgggaaaaagttgaaaaaatctggtgcttctggtttagggtttcgaaagagggcaagagtggagagattcttcggtagaaggacgaagaaattaggaggcagtatattacttttctataccaagacgctttgctttttcattttaccagaccagacaacctttttttttttttgctctaacgtcatttggaaatcatatttttattaccaggaagcccttcttttaaaaacaaaataagaataatagttcaacggaaatatgaatttgcatgttgacaatgataaaaagttatgaattagtcaattaaaaaagtgtgtaagttatgtattagtcaattaaaaaagtgtgtatgatgggatattgtagctatctattatatatgtatatttagtgccattttcgtgtcacaccatgtcttcatttttatttttctttaccatgtgttatacttttttgttataaaaagttgatatatatatattatcgcttaactttttttaagtaactataaaatgggtatcatatataacaaacatatataagtattttgcaatttatgcgatatataaaaataaaataaaataaatctacacgattctatatgttatattataaagatcacgccatattattctatctataagaatacaacgtacgggattatatatgatagacgattgtatttgcgggacattgagatgtttccgaaaatagtcatcaaatatcaaaccagaatttgatgtgaaaacactaattaaaacatataattgacaactagactatatcatttgttaagttgagcgttgaaagaaaatgaaagagtgtagactgtagtatgtatgagtttcccaaaggatggtgcttgaatattattgggaagagactttggttggttcggttgaatgaagatttttacctgccatgttgatagagaaaggcaaataaatgtaggggtcgatgtctaacgtaaagactggatcaaccaagagtcctcctcctcgtcttcaccaaaaaaaaagagtcctcctcgtggaaacttatttcttctccagccaagatctcatctcatctcttcactctatgaaatataaaggaatcttatggtttttctaaaaactatagtacgtctatataccaaaggaaacaatataaaatcagttaatctgataaattttgagtaaataataaagttaactttgtacttacctatatcaaactaattcacaaaataaagtaataataacaaagaatttttagtagatccacaatatacacacacactatgagaaatcataatagagaattttaatgattttgtctaactcatagcaacaagtcgctttggccgagtggttaaggcgtgtgcctgctaagtacatgggctctgcccgcgagagttcgaatctctcaggcgacgtttcttttgttttcggccataaaggaaaaagcccaattaacacgtctcgcttataagcccataaagcaaacaatgggctgtctctgtctcactcacacacgcgttttcctactttttgactatttttataaccggcgggtctgacttaattagggttttctttaataatcagacactctctcactcgtttcgtcaacattgaacacagacaaaaccgcgtcacaaaacaaaactcgctacaaataaatacctttgtttccctcttcttctccttcactcacaacatctcaatttcattctctcttctctctccaatttcacaaca

SEQ ID NO: 366 - DNA, 3000 bp, Arabidopsis thaliana
ttgttcgatggtcatatttaatattcttacgatcgatcttacctttgtatgcttgtttccactgcatgccatggtaatggactagtaatgtcattttcatttgtccccatttaaattgtttcggaaactaagaaaccgtctaaaagtataatgattagttttctgtcacaatgaatgaataccataattagaaactgctattgagctaaaaatttgctcaaccgaagagtaatcgttttttctggtaatttcataacttcagtcggtttgccaatgccacgtaaagaatcatacttctagtaagtcgacacgtcatctcaataagaccaaacagcttcacacgtcagaaagtattaaatagtaaatacaaaatattgacgttaaaaatcgaaaagaaaccttttttttttctctgtaaagataatatattaagataaatatcttacaaaatacaaactgataaccataaacttagccccaagaaccccttattccggttacaaaatccggcatcagttaaacaggaaaaacaaacttaaagccatgtttgtggaatctctaaacttcttacaatcttaacttgtaattgctttccaaaaacttgaaaaatataaaacattaagaaacaatcaattttagaattgattttcaagtcttcttgacctcacttgataataaaaagacttcggcaattaagacttatgcttcccaaaattgcatgacggagcctcaattgaggtgaattgaaacagtctaaaagagcaaggaccggtttaattttaaaagaaacctagctgtcttaatttaatttatttttgtagcattttctcgcctgtctaatccacttttttattcgacatatttgttatatataccgtacatctggactatacgtatatctatcacacacccatattattatagtttgtaaatttaataataatatctgacgattattctaataattgagatattccgtcacaaatcttaatttattttgttacactttacaggtgttcatacttagtggtgtcgaaaagctttacagggactcatctacgcgtaatttaaaaaaggagaccccattatgatcttttctatataattacaacaacctctttaagtaaagtaaattttatttttagttgaattatattctttgtgaatcgtttattcgctttgcatacgtggaaatgaacatgatattgagtaggaatcgcttcttattaacgtctcccaaatacaaacaattttttcatcattcaacacgacgttttttgaacgttccgtttcactttccatgtttccgcgtttttttgaaacgcaatttaccttttatcgattcggcaatttttagtggatagagttataaaacaattaatcagaatggtgactataaacgaattattcgtaatgtttgttgtatactattgaagtagtcggtgcataaagacaaaacgtgcgttggtgttagttaattacttctaccaaggctctattaacagtatacgataatgaaaagttgaaaacatactaactaacatgtattcacaagtaaacaatgccatactctagtagtccaaagttcaaaatactctttacagtgtgtaaaaattcaatatgtgggctcgaactctgaaatagtcgaagataattttgtgggttaagacaccagaatatgcaatttttttacttatgttttttttgtctatttgttagtaaatgcaaatttccaaaataattgtaaaagaagagaccatacaagtaacatgcgaaataacgtaataatacataatacataatacttaatgtgactccaccactgtacacgtaagccaaacttttattcaatgttatgatatatttcaattttcatttttttaatataatttttacttaattattagatgatatgacacatatatttataaaatttcagttccttaaatgttattaaataatttaaatagtaccatgatttaaattggtaaaaaatatgaaggaaagcttttgctaaccttctttacttctgtttttttttctttttcttttggttagatagattccatttaacttaaaataataatccacagttttttttttttttttttaacacaataatccacagatttttttaatgagaataaaactaaaaaggaaatttgatgccaccagcatttaattagcgcgtgccacgtagtttagtttccaaacaattaaaaatttacccataaccggcccaagaacttttatttacttacctattaaccctagatctatatatttgctcactactgttttatcccaaactttagagagataaagcattctattagtttcccggcgaggactagtcacattttccggcgaacttaccggaattttctctccaggtagaacttgtttctcgtctcgattttctcttcaaccgactacgaaacgagtttcggatttcgagaaaagcttacgaataaaaattttaattactgttttgtttaaattaaaatttcgcagtgttggtcgctttgtctcctgttgttcttattcttcgtcttctttagtcttacctaatttgaatttttgttgactactactggagtaaaccgtttcacagcgtttttctcgtggtaggagtgacttcgcgttcatcgatttttttttttttttttccgattttacatgatattgttgtgatttaaggctaatgtcaaggatttttgaagaaatctgagaaaatatctgtggctgttttgtcgcactctggatttttcccagagagaagaagatactttgtttcgaagaagatatttatcttttttttttttcttactttttttttatcccggagaaattgcttttttcttgcttgatatttcacgtggttgtcgaaagcagaagcaacctttaaactgcaaacttacttatcttttgattttttctcagtggttttgagatttagggatttgagtggttttcttcttgtctcttgcgactgcaacg

SEQ ID NO: 367 - DNA, 3000 bp, Arabidopsis thaliana
atgtaaaactactgtaaggcattagttttttttggccggttctttttgagacaagttatattaattagttttaccattttgcctgggattattatgttgtgtgtatataaactatatgttatacacattcgattgaattggagtgcaaaagatatggtcctaactccttattctctaacttcaaatttatctatgaagcttgtggaaatttttcatcttttaagtacgtttttgcaatgcaaaagaagaaagaaaaagcctaagaggttacttgtgaccagaatttgttatatgattggatcgtgcatgaaacgaactgtggtggatactggatagtggatcctcgaatgttaattgatgtaggtaagctacgaggggattagtctctagtgacaccaaaaatattgtatctttctttttatgaaagaaaccaaaaaggagaaaaggtataactaatagtcatggtggtatggcaaattataacctttactctcatgtaacgttgttctaccactaattttttaataacctttataactcgaaaatctagacacatactttgtcatttctcataacatagggtcatatgtaactgttgccaaaagaaaattgatcttttgtaattacgttagtgcttatatttttgttgcagaaacacaaaaatacggaccaaagctagtagtctactatctttggaactagtgttgtgttgtcggcgtaccaaagttaattttgattaaataatttaagtgagtgagttacgagtaaataaaagacacctagattcatatgattctgttactagctaagctaatctagataaattggatatcattgattaaatgttattatatgccaaattaggcgtgataagtttatggccaaacattctttttaaagcaaacgatagtaataagagagaataatgacggatcaaatggaaacgttacaatggttgattgactaatccctaactttttcttgcgataagataatatttagtgtcatttttagtaggaatagcactttaaattaaattatctgtatattaagacaccccgacatagttttgtacatcgcatttaaaccacacttgtttaattaaatcgcgagacgacgttttttttttttatagatgttattttgttatagaaagaagattaattcataaccacaaaaaccataatctagactcgatgcaacttttgtttggttttaagctctccatcatatttttgtttttttttgaggaagggtttaaagctctccataactttaatgctacaaaattacatattatcatcaaagtaaccaaagcacaacatgtcaaacacacacacgactgacacacgctcctttatccttaagcctttaatttagaacaatgtcacccactttgtcctaaatatttcgaaataggaataaaatatataaatttctgaaatgatcaaaatttgacgagttaaaaaaaaaagaaatcatgaaatgatcaaatttgatgcttcaaaaaaaaaaaatataactattattaacgtgaacttttttgggtgaaaagtatttatcataattaatacatatttatcttcttcttttttgaatacttgctaaccattatagcattttcaccatgtaaatcgactaggttacgttattaaaataaaaagatataatcatttttttctgtgtactagaaagcatgtatatcggttaaacgatttaatggtgggaattgggatggtgatatttagtgtttcaccatgtggtttcagagaccatgatggtatgtaacaaaaagaaaaagaaaaaaggaagtgttacgcacgtaagctaacaattgtaagttggtgcaagtcgacatatcgccactcactctacatctttctccaaagccaaaccctaaagtgatcaactttaatatatcttcccttttgtttagttttgaatatatttttcaattacattaacatcagattgataaattaattttccaaaataataataaaacttctttaaagtcagaaagactcctagaaatacgaatttctgaaaatctccaaagaaacaaggattgttagttatttattatacagtttttgataatggttttaatttgagtttggataatatataccctcttggaggaaagataattcactaatgttgaaagaaagaaaaaaatcctaattactagtacgcgttagtctcatatgcatggaaattggattcttaaatcttaacgtaacacataatattatggatgtgattttatcttccaataaacaatttgaaatatacttgtttttaagaagagaaatgcattagatgaaaataaaagtgttatatatatggaccaaaattaattattgccgatagtgacactatcataatgttctattattttcacgtatctatatacaaactccttttttttttttttttgcaatgtgcttgtcccaatctcttttcaagtaaaggagtaaaagacaaatcctaaaaagagggaaacaaaatatccgttaatagtttctacatgcagggtatctttatatatatattgaataaaactcaattaaaaataaagtctagataaaaagtggttgaggaattaaaaggtatttaacaaacaagatttatatagcagaaacgtatatagaacgtatactctgaagatatatatttactctgttttttagaaaggtagtttgttttctaggaactaaaagataagtaagttttggcgtttaagaaatatgattctattttagattaaatatttagacatgtattatgtagatgtagagaggcgtgtgcttctacccaaatatgtgtacattaataaaacttttctcaaagaaaaagccagattttgtggtctaaaagctttataaatatagttcctcacacaaagcataaccttacttcttcttctctctctctctctttatctccctcaatacacacacacacacacaaacacaagctttaatatactctcttttg

SEQ ID NO: 368 - DNA, 3000 bp, Arabidopsis thaliana
catctctgagcatgtgttgattcgattatcaatcggattaaagatttgaatatacaaatcagattaaatcaggagcttgataaggagctagttcaaatataataatcaaaattatggtaaacctgaacccattttctaacagcgaagaggggcactggttcggaaaccaagcaaggtggatgcggtgacgggaagggaacaataaaatgaacatatgaaaaccatttagtagggtttaaaaatgtttattatttttggtagaagaaggttaagacttgagaccatatagacagctgatatattcatatacatgggcggttcttggaaggatctaggggagcaaatgtcccatgttatcggctgatgtattagattacatgcataagcgttattgttacgatcatgtgaagcaaaaacacggcgttcgaggatcaacagacccaccacacgtaagcgtctctcaaaaatcaaaattggtctgctacaaacctactttcccgccagctaaaccaagattattcattttatttttattttttctgctacacaaaaacaaaaaactcatctaagttggtatttattgtttatataatctttgtttaaatgtttgataaagagctcactaactttataagtaattagctagtatattttgtttagcaaaaaaaaaaatagctagtatagaaaaacaagccaaataatttatttattttttggtcaaggaacaagcctaataattatggttgatatttttgatgtaattgacatcgtaagtatgtaatacgtcgtcctccagtaaaagtgttgaatggtgaacgacaattgtagagcgataacctcattttttttaggtaaatttgttttttaatccatcatatcaattctttcaaagaaaaaatgaaccaaccatttgtataacgtgcgttcaacctgttacctctacatgcagcataaaatttgtgatagtgacgaataacgttgattactctttgtacttccttgattttagtgaatgtaatgttgctctatcgaggtggagcctcgtaacattggtaaggctacaaaaatgaacatcgctctctctcttctttaagcattcctaaatcgtgtttttgtttttctttttggcagcatcttttattttgtttaaacgcctaaaactgcctttgatcttttttcctttttattgatagaatgagataggacaacaaataccttttttgccgggaaaattcaaaggttgttgatgattccttgtgtccgcaactagaaagagaaaagtctgtcgtatcaaattagatattgacaaaaatgtcaaaatatatgaagaagtgtgaggggaaaccgttgattgaacgtaagacatttgaaaaatggatatgtagtagtttctagatttgcttacaaggaatgttgagttgtatcattttctctaacgcaatagctaacgtgcacgacttttttttttttatgtaaacttcaaacaaaccacgatcaacgcgtttactatttattgcatggaaactatagcaagtgtgacaactcatatcaatttgtgatgaattgattaactacgtaggtagtataatatttgtaagttggttattcacgtaagaaatattgtattttactcttatccagattatttaagaactcgtttttcaatataatgtttgacattttatactcgagttaataaacaaattagctttacattgacaaaattctgttgtatattatttataattaatcttgactatgggtaattaaataatatttttttggaaaaaaatacattggattttctcaaatgatcacacttctattaaaaccaaaatagtacgtatacgctctagacgattctaaatagatgattaatttggctcgattcattaattcaaaaaataataatatttagtgttttaaattagaattaaaatattaaataattatcggatatttcagtgttttaaattattgaggatgatttttgtttagtaatgacgtcagattgtctaaggaatagtttgggaaaaaaatctgaatcaaatatgactaacaaatggttattggttattgaactggaccataacaaaaagacacacacacaaaaaaaaaaactttttttatctggtttgctccatggataagaatatagtagctaggatatcctgatctttagataacggtagaacatgtggcatgtgtttattgtttatttttattttattttgagaacaaaatagttacattgtttggttatatataaaaaaaaaacagaccaaaaagacaaaaccaaagcttaaacaaaaaaagaaaagaaaaacttaattagaccggttaacactaaactggtttatgtaaaacggattcataaatgtatctagacattcacttacataaaattcatcacaaaatttcacccaattacggttttgattcggtatagggaccaccttcaaaattacccaataaataaagagtggataacaactagcataaaataatcaaagcatccactaagacacaaaacacaatttcataaagatgatgatgaatcacataactttaaataaatattctttcaaaaaggcaaaacttttaaataaatatcattcgcctgtcggccaagaaaaaaaaaaagtaaacaaaaataaatatcatacgtattgacaacaaaaaattcatacgccagtccaattacaaattacacaatatttaaaaatttaaataaggaaaacagaagaagatacaatttcaaattaaaaaacaaaatacgtgtatataaaattgaataaaaccccaacagaaacgtgacacaaaagaaaagattggggaagctgacctctgcctttcctcctccattaatcaaggaatataaatcagctttaaactcagtcctcttatggaagacaaaaaagcaaatatttattcgtaaatataacttcagaaccctttcaacaaaactctctctgttctttctccgtggagaagttaaag

SEQ ID NO: 369 - DNA, 3000 bp, Arabidopsis thaliana
ggtgatgcggctataatcttggacatgggtatcactgttgtcgctaaagatattccagggatcaagaaaaactccatttatttcagtggcctcaaccaccccttaacggatcccgaatgtagatttgtctatgatctcacaaccggcaccatggaacctttgccacaatgcgttctctcctccatgctcttctctgattctcgatggttcttacctggtttcaccagttaattggacatgtttctgcttcttgttccatttttttttgtttttaaattattaatacctttgcttttacttagtcttttgatggttagtttctttgtattatgcatatgttttagacttcatgacttcaaggtgttacgtgtttcaattatcttatttgttaccagtagtaatagtttggttagaacttcgatgatagaggttttggcacactatgattcgaatctcattatgtgacccaaaaaaagaaaaagaaaaacaaatcataagggaattcatcgaccacatcctaatacagtaatatctatgctgaatgattcatagagattagggtaatttaataataaaaagttgggttccaccttcacaagatcaaaattcaagattcgaatagttgagacgaagtcccaaaagaaataagacgagaacatgtcttctgtttttgttcctgaagaccctcaagagtcaagacacaccaaacaacatatgcacagaacacagactcattcatacatagtttctattaaagtatggactttaggtcatcctaagccatatatcattcattatcaaacaaggaacaggtctacatccatcaaccggaagttcaactaatcttaatttactttctcagaaaatgtgcagggaatgacttacaggcttaaaaaaaagaaagaaagaaacaattcttacaaaaaaagagcacaatgcggaagattactacctctggaggtcaaacacagcacggtggatggtgttcacttgaaagtggacagacgaggaagcttgtccctcagatagtaaagccttgctcttcttactttcctgtgactcaccacttttatctctttgatgttgggagagtatctgtcaaatcaaacgattaggagaatcaacacataccaaacacttttcttaattcccacatggtaagaaaataaccgatatatcacaggaagtttctcgagactcgtatgttatacagcagaatgaaagatagtaaacatgagcagacatgatagttgccatagtgattcaggctgccataactgggaaggtataacagcaactaaagacttattacagtaaaacctctgcacagagtctaactattatacagggactttatgtaaggtaacacaaagtataactcagtatctatgtataaacttggttttattgaaaagctcagaacatgtgaaaagactcataatcaaagtaggtcataccaaatggtcactggagaggggaaaaaactcacatgggaaacacaatttcaacaccgatacccgcaataattctccgaatacgaatggtagtgtgtatgcctgcattttgtctcgacatcactatgcctttgtagatagatagcctacgtttgttctcaggaacttcctgccaagccaaacaccatatcccaccaataatcaaaaacatcgattcaatccataacttaagaggcttcaaaaatatcaacaacttaccaatttgatttctacaatatctcctgtcctgatttctggaacaggtctcactttctctgctacctcaattgctttctggttcagtatctacaacaatcaacagataataacattcaatctccctcaacattgcctataagataactatagaaaaagcaagtccctcaacacaaatgtgtacacagagacttactgattcctaattgctaaacactcataatttggattactgataaacaaagaagttcactaacccccatgacatctccgagcttgatcctaggttttcttgtaggtttagcttcgaccacttcctctacatttccttccgtatcagcgatttcagcaacaaattcttcagattcagcttctgtgttaccttcttctgctctaacgataaactcatttctcaccctagtatcgagtgagaacccaaatttcgagccgggatgattcagagaaagcctagaaactgatatacgagaatccatcgatggtgcacacgatagaaacgaagaaaaccctaaattcttcgatgattgcgtagggtttctgggtatcatatgcaatgcctaaaaatcccatagaaacaaataatcaacaataatgaattaagtgaaaatagagatttcataagctttcgtatatttaaacctgaggaagacgatgaaagctcatcgccatagctgcagcaaactctcagttactcggagaaaatggagggaagacagtggaaaagagccttatctgcttttcgcttcctattttggcacacgtatgccatcgcacgtgtgaattttctttatgggccgtttgttattgtgggcctttagtatatcaatattaatataaatagatagtactatgatttataaaaatatcaataaaagagtcggctaatgacacagtcttattatgattacataaacctataatttgggcccaccaccacgtcggtcgtgtgggccgtcgcttcatgcgtaccaaagtggtcaccgtggcatgacaactgttgttctgccttttggctctaccgtaacaaataggacacgtgtcgcgtcttcacagtttatgtcgtgttctatctctctctgtctctctctctctcccgccaatatctctctccctttggtctcttctctctaatcgctctctctcaatcaaattaattcgtgattctgatttatcaaacactaaaacaaatggatttgggtatttcattttgatccgtaaaggttgattcttttttttttttgttatcattgaaaattttgttttgttgtgagag

SEQ ID NO: 370 - DNA, 3000 bp, Arabidopsis thaliana
gaaggaatctgacttaaaaggagaaactaaatttaggggagacaaaagagaaaagtcgaacaacaaaggaaagctacaatattttatgtttatttatttcagagattgaagtaagaataaaaatagattttttaagagctttggtttggtcggatagattagattcgttggatgagaatgtgatggtgttttattttacggcggcgattgagcgaagaaaggtcttttattagtgctcaccagctactacttctacacctctctgactctgtctctctccgctgtttcctctcaccttctttcttctgcttttgcattattaaatttaaaccagtttctcttttgtttatcgtttaaattgtaattgaaaaaaaaaactaaaattagaatgttggtttgtacaaaatcaaaatgcatttctggttttactagttaccgttaattgtaaaaaaatttaagtattaagcacgatggttttattctcgtcgtatgagaagactaatttaaatacatgtgatctacttgtaaaagaagcaaccgttcattcaatctcctatcagaaagaatagtaatctcttgagattttttcttaagataaagatatgccaaatatttaaacagtattatggcgtcactgactattatgacgtaagagattgacttttccatatattgcaactttctggagccccgcacataatccctaataagttttacttttgggccttgtttattcactgatccagcccaatgttcaaatacaaaattcagacaccccaaaggccgtattattgtattgttttagactttagaccttacaataaggcctaaaatgataacatattacacatttcaattccagataaaaaaaagaaccgaaaattttaattataaacgctatcaaattgacattttcacaagactgaatcaaatttgacacctccacgtacacaagcaaaattatattttgggttttgtatcaatgtgctggctgattttttttagcaaaactgtcctgtaacatctctccaacttggtttgaattcgttttaacattagtttggtgacaaacataacgttattgaatttttcatttttccgtaataatcattctgatttttttcttttcaaaatgttgttactagatgtttctttcccaagaataatatcttaaatcagtaatcactactaccagtaaacataaatggtacgtttctcctcattctacggaatttttaagaagcaatgatgatgattaattgaggatgtggacaagaatctttatatattcgcattcacatgccataactttcaaagtctatgaaaaaagattctattgcgtgtttatattctgtggtgtgtactgtagttccaaacataacgcttgtactacgttcatttccggaaaatatctaagaaatatggagtcataaatatttattaaccaattagatgtttttcctatgttctaaatacatttatggtaatctttgcggtcaaatatacgaactttaacaacgacgtttaacaatatatcttttgttttatacatatcaagttttgatatacggacgatagatatttattttcagaaaaccagtagttgtcgtagtcacatggtttgtttttcgttgatcaaaatttgttaatgttattcatttagaattagagactgtatatcgaatttggtactcggttctaaaaaaaaaaaaaactcaatatgattttttatacattctttttcttcccttttaatctgtaagaagaatagtaaagtgaagaagaaaaaactattcattatattgtaacatacgaatacgactcacaattaactaaagttaaagtgtctcattgtatttggactttggacattattctccattattgcattgtttctttctttcttgattaattatgtaaagttgaaatgatttgaagatgctttccggatgtaaacaaactaaactttactttaccaataactttgttttcagaaaactcagatatttatctctagtttctcgtataagtcccaatgaatctaagatttcaaaaaccaatcctatatttgtttcatatttacaaaaaaacaccaaatatttttccccaattatgccgacattaaactcatctttttacatacaaaatcccaaattaatatccgtttttacctttacttcatgaaagcgaagatggtaaaaagcagaaacatttcgagatattaatttgattgtataggcccgtgaataaactcgtggacccaaatcgaaaagataacaaaatttaaagatgtacttaattctctgaaaaaattctgtacgcaaacacgagaaagagaagagagacatacacacacaatacacatacgtggtttgagaggacaggagcaaaacggcaggtgtcactaatcccataggcttctctctctgttcactgtccttccgcacaaaaaaaaaaagtattcatttttatattctcacggttacttcgaaatctagctttcgttttctttttttttgatttaaaccaaaagggtaaacaatgctttatgattgcttagtgacgccattgaagcagcggctcactgatagtggcttcttctgcctccaattccaagttgctaaccctagttttcatctctctctctgtatatcatattctctcgtactttcttactttctcttctacttggtagagataaaaagtagtcaaattttattcaaagttttgattttgacatctgaggtttcacctctgttttttttttctagaactcctttgggtatgtgtcttttacgtcactaaagggtttgttatagtcttaggtcatgctttttggtgttatctctctctgttttatcttttagctcaccaagtgattgtgtctgattttcgaattttcaggtggattttgtttcactcactcatcgtcgttgatcagtgactctgtttttgcgaaattctcttcagatttcttgataaaagatagaagacggaatt

SEQ ID NO: 371 - DNA, 3000 bp, Arabidopsis thaliana
gtgcctcttgctattcgacgcctgttgcaggttcaagctgtgcttctattattgggtggtcgtgaattacctcaggcagcccctcctggcctaggatcacctcatcagaacaacagagtatcggtaataaaatatatgatggcatttatgggacataagttcccttccttgatacattgcttgactgactgactgactaatcaatgaaacagagtttacctggtactcctcaaaggtttagtattccgcagcgattagcttctttggtcagatttcgagagaaacggaaaggaaggaattttgataagaagattcggtatacagtccgcaaggaggtagctttgaggtacattgatgtctaaatcaacaacttggtctagttatacttcttttatggttgctctcccaaaattaaggttcgcatcttgattactttttgttttctggtatacaggatgcaacgcaataaaggtcagttcacatctgccaagtcaaacaatgatgaagctgcatctgctggatctagctgggggtcgaatcaaacctgggccatagaaagtagtgaggctcagcatcaagagatctcgtaagtttagaaatgctttgaaagtaaactgcgagttcctgacatactttttaacttgaaccaacttaacgtagttattatgggtttgctaagcaactttagaagttgtttttgcttccaacctaatgtagcatctgacttagttattaaactgaaccatcctaatgtagagatgataggtttattaagcatcttagatgttgtttttggtttcagaaacgttgtagaggtactagaactctgaaacctatcaatgattcaatatcaagacatacacattgcatatgtaatatttaacatgagcatggacctatacgaattggtaacattgaaggaccaatacagacaaaatattatataaaagctcttccatgcctgaagcaaaatgacttctgtgatagatgattggttaagacaggttgtgatgactaatattgtatcctggaactgagaatttttataataactttggaatagacaattgtcgtttaagtctttgtagatttgagtttttcttcttgatagccttactttagttggtaagaacatatctgattttacttcctctgaatggcttgatacctgtaagatgtcggcactgtggaattggcgagaagtcaactccaatgatgcgacgtggacctgccgggccaagaacactttgcaatgcatgtggacttatgtgggcaaacaaggcaagacaatacttgcttcttaatttgatcaactctctttatcttgctcattttgtagcactagtgattcgatgattagtctgtctaaatgaggacgacatttatactttcagggtgcttttagggacttatccaaagcctctcctcaaacagcccagaatcttcctttaaataagaatgaagtaagcaacatcatgttttgaccaaacaatttgttgtacgaaaaggaatccattcgtctttatcataacttgtgcatgtctgatctatctttgcaggatgcaaatcttgagactgatcatcaaataatgataacagtggccaatgacataagcaactcacagtgaggacatgttggctcttgccattacaagcaagagaaagatcccaacagagtttgaatcgcctcaggttctgtagctttatcattccctttgaaagaatctgactcgatttaggttatcaggatttgatctatgacaatgtaatctgagtgataatgatctgcaatgttttgcttcttctttttttatgattcaaaaatgctttatagactgttgttgcattggtccatactctgatgtaacgtctagttgcagtctgtgttttaccctattttaaagacaaactaactttatttaagaactcaccaaaagagtagtctccttatgaccacagggttgttttggagacttagtagcctcatgtaaagtgaaccatgttcaatgcctcatgcttctctaagtcaagaaacaaaaagaggcttgtgaattgtgatattattagccaaaggaacttgccaaaggaacttgccaaaacaaggagacaaactaaaatggttcagtgcgaatgtgactgctcctttgttttcagtggcaaagatttttacacagaattttgcctaaaagactttcaaatatcccttagatcaaaaaaaaaaaaaaaaaaaaaagagactttaaaatatcccaatttgtgagagatattttagattccatttttgtttttattttagcttaatagacaaaatcttatttcttgcattttctcttctagtgaattgtctcatcttatcatgaaaatctgaaaatcttctcatagtttcattttttaataatatttatattgactttttagcataccagtcattacatttcaatttttctgataaactacattacaatgttattagttaatttatgagagctaagctttggaaataaatggtataaaagaatattcttataatctttgtggacaaaagattattatcttcgaaaatagggaaaattgtaaaagatctttttgatgattttgattttgggtttttgttatatcttcaaagttttaatttttctttttgttactaaatttcactgaattttgggattttttaaattttccaaaattaaaaataaaatttagaaaaaaaaaaaaaaggaaaaagaaagatcttttgcttagcttcaagttaatggacaacacgcagagaacagaagacctccgccgagccctatcatcactctgagctcaaaatcatcttcctcctttctcaatccaaatcttcttcttaccaattctttttcttttcaaagtttcataaacagattacaccaaatcccaattctccgtgacacagctttctccttttttgggaatcatttgttaactttcccggagaaaaaaaaatcaatacttgcatgctcttaagactctgaa

SEQ ID NO: 372 - DNA, 3000 bp, Arabidopsis thaliana
attctcaaaagtcttctacaaaaacctttgcagtcacatgtttcttgccagctcttttgataaatatcagcatgaaaagaccaacgaaaaaaaagtaataataattcgaagcaaaatgtcatactgatattaatatgatgtgatcagtgtatttaatgtaatttgaaattaatcataagagtacaaagtgggaatgcaaatacgatggtccaccgatccttgtcatggtcttgtacacacttgaaacagaatacaagtcaacgaaggtgtctcttattgatttctcttacttcttaggcttatagctcttgccttctgaaagttacagaatattccctttcatagaatcttcaactttctattttcatgttattggtttaaaggtctaatagaatctttaatgttgtaatgtgtcttagacttaaatgaattcattacttgaagacatgtattccacgctgaaaacacaattcttttgaatatagttttatgatataatcatgaaaacctatatttagatttgcttaggactctaaatatatcacaatggatacgatcttgaaatcccacttatttcatctaactccccaaaaaaagaaaaaaaagatgaatttgttatgcacaactggattataaaaaatcgacttttatatcaaaaacctgaattcaatctaacagtatatactacaaaaaaatgatcaaatgtttatatatgtaggtgcaaatattttcctataacatacttgagatagtaacttaagaaatgattaataattatgtttctttcagcagggtcaaaaatgtattcccacatttaacatgctttagtaagtaattatggtatactttataagaggatattatataaatatctcttagtataaccatatgaagtcggtagatatgatcctctcaaatacaaaatagaaaaagtgagctttctaagagttggagttatctatcaaactccatatacatttttcgttattcgatcatgaccattaaaatgcatatgtttgatagtgacccgcaccacacagctcagcatattgagacagattagtaaaagcagtccaaaccttaggcacccagtccacggttcatatcatctgaccattgagaatggtgaagagagataagatgatcgaacggtgtacaataatatgaccataaaatcgaacggtgatacggtataggatcccacgtaaaggtccaaacaaaaaaaaattaataaagaagaaaagacaaagagggtttgcgtagaaatttgatggctcgcgcatgcgacagtgttaggcacttgcatttgcctaaaaggcgataaaagcctacctcatcttatcgtatttctctttctgtttctgtcttcactcaccgatttttatgtttgtgttcaatttgaattttacaagtttggttggacttaatctttcctttaacataaacattcaatgataattttattattaatgttcatttcttgtgaagattttcattgtttctatatataatatatattttacattgagaaaaaaaaatgatgcgaattgttttgaagttgaagtggttgattaatatttttttctacaataaatcaatgaaaatttagaattgaaaaatatctagacatggaatttctcaactcaacatctagataaacatatgtaccacacattcgagcaatcgtataaaattatatacgaataaatagaattagtttctttctcggaaattctgttaatatttttaggaggattaagtgggttcgaaatttaatcacttcctgcacaaattcatctcaatgtattaattggtgatatgtcatttttttattttattttttggtatgagcttccaaagttttaaggccagctctatatgtgtactattgtttctaactttattatattaaattttggtgatatgtgtttctttgtttgattgcaacccaaaatagtttaaggttcatcttagagtgcgatgactttttgtgcaaaaatattagatcatgttggtatgtacgttttgagttttatttatttgtttaccaattgaacgactctcaacaagcaattgtatgccaagatgacatattggacgtttcaagtgtgtgaattgtataaagcagtaaataaaatctactcttattaactagtttgaaagagagttttaacttcgaagaatctatcgccatgagtcaaaatcgtataaatgtgacaaatgtttatctctatcaataatagtaaaaattttaaaaggttctatataaattttaagattttgtcaggatcattaaagtgtagaactaagtcaactgattgattaatagaaaaaatcgatacaatctcacttcctttaagaaaataaaaataaaatatgctttagagaaaataaaatctcgcttatttatgagatatcatatcatttttaggtaaaaaagattagatgtccttttgagacacatcataccatatatatgaccgacaacacacataaaaccgcgtgaacaaaaaatatcatccatcaaccccttacgatgcaaatgtactgtaaaagatggttcattaatttaacatcgtattttaacgttacaattgtatggaacatggaaggttcacaatacgtggaacaaaacaataatgttacgtacggtgtaagaaaaacaaaaaaaacatagcactaaaatagttttcttttaattttcctcttcaaacttctcacgtggaggctactagtggcgaacgtcattcaaatttacccacacccaccatatattatctactcactcccttatatatacacacttccacaaataattcactacacccaaaaaagcttctaacaaagagaaagtgtctgtatgttgtgcccactctctacatttatcaatcacttcatgtgtgttaccttgattgcaaaaaagtgagaatatattctcacaacattaaatccaccccgaaatcgaagtgagtatatcacgagtgtagtaatatcttagag

SEQ ID NO: 373 - DNA, 3000 bp, Arabidopsis thaliana
tcaagtggtgaaggaaatggtggacaagatgggttacgaagtatgtttcgtggtttcagtttctgctcttttatttaaatatccttgtctcgtgaagattgtgtttcatgaaaattttctgaactattctacaggttagacttgttagagtcaccaaaagagttcacgaggcatattttgcccagttattcctttcaaaggtctgcaactggtctcttatatacaacttacattcagccttggaaacttaaatcatttcctatgtattaaggctggttttgggacgatattgcaggtgggtaatgcctcggagtgtgtcagctttgatcttaggccttcagatgcaatcaatatagctgttagatgcaaggtattacatagctatgttaattaatcagctgaggtaaatacaaatgtgtgtttggcggttgaaaattgtgttgatcgttttgtagatacctatccaagtgaacaagtaccttgcatatagtgatggaatgagagtcattgagtcagggaagatatcaacaccggcaccagcttcagatggtttattatttactgaacaagaccggtaaattttcagacaccttaaagatcaatctttgcagatcacatctttttactgtgaatttgagtgccataaacttttttgactttgtgcagaccaaatggtcaggcttgtcttgatacgaaagagttcaatattttgagcaaaatgatgcaagccgttgatgaagagcgatatgatgaagccggtaagctttgctctagtctctatatccacaatgtacactttattagtggttacataacttactgctatgattggtggcccagcatttgagaccaatctgatttatgtatgtaacagaaacttttatagcttttcgtaaatcttggtctaatctctaatgatcaatacactgttggttatatgatttgcagctgagtggagagacaagcttggtcagtttcgggccaaacgtaacttgaggaaatacacatgagagaggtaaggagatataaacgaaaatgcatactaaatgacgttatcatttctcgatacttatgtttctccttggggcagctcgatcaacaattattggctgtgtacataaactaagaagaaagtcattggtcggaatcaaagtggaggaagaagcctgaagtgtcgtctctgtatgatggagatcgaagaatgcttctgcactttacccatttccctaaaaaataaacaaaaaaaaatgtataatgtatgtatgtagcgtgatgtgtacatattacttattaatctatgcaaattaagctcactctaattacttttaagtttccttttaagtcttatgttcgtcgtatttgttttcgtgcttctttctttttataataatttaattatatatttttgttattacttgcagctgtttgttgtttatcatagaagcaatgtggcatatggttaacatgaaatttgaagaaaagacaaaatcactggctttgccgacatatctgcagtgtctttgttttgtttgttagtactgcattgtctaaatctaaatcgtgacaataaaacaggataattatttttcattatgatgttctttggtaaatatgtctataaatattcttactaatttacaaatatatatattcatgtaaattttattattcaagagatcttacgcagacatggttttcacagtaccattaagattatattcaactggtttgtattatatttaatttataaataaaaattgtcaattgataataaatggaaagaaaaaattaaaatgaaaaaaaatccatatccattcaaataaaatatctcgcaacatacgtttcatacgacaaatagtgtgacaaactgacaaccacttgtcagaattgggctctcaatatggggaaaaaatagtcaatgttattaaaaagacaaaaataaataaataaaggaaaatatatctaaaatcaataagagattaaaaaatagaaataaatcatgtatttggcacataaacaagtcatatatcgacaaaagcctaagtttggtagatgaatagtgattttaaatggtacataagcaattcaaatatgtatagacaaataagcctaattttataacatttttttgttttatattacaaatctaacatttttttaattcaaatatcccactatcctttttgaatcaacagaaaaacatctcattaaactaaaaaatctcagattttgaacatgtttaggtaaacaaccatcatctcgtcgtttcttttttaccaaacatcaattttactaagttatcagaaaaacatttttcttttatcaagaattattcaaaaaccgataagtttacatgaaaaaagaaagtaatacagatacgcgccttcttgattaaacaatcaatccgaatattgttataacgaataaaaaaatatattaaaagaaagaaaagaaataaagaaagatcgaaagtagccatttgaatattgatatttgattcttaacaaatttatctcatatagtaagtatccgtctcactaaatttgaaaatacattagtcgatatataattattaactaattataacggtatttagtaacggtatttaccgtgcgcggggactcatctaattaaaaaactaaattgaaaaaacctcaaaaaatagtagttaccacttaccagcaaacattcaaaaaaaagaaaacagagtatgactgattttaaagtttctaagaagaaaagaaggaaaaaaatcaccgacgagtctttgtgtttccggtcacaattaatgaaaaccatttctagtctaacttttgttgtaacgcaagttttgaaacttattaattaaagaagactaataattattataaaaccccatcatcactttacttctccctcttacgtctctttcaatttcctctctgcagaatcgcttctctctctctctcggctccgccgattccgagttccccgattctcggattcttctgaagatttctc

SEQ ID NO: 374 - DNA, 3000 bp, Arabidopsis thaliana
atctagagtaatataaaaaggatatgatcaatccactcttggcttgattttgaaattggaaatccaccaaacttaacaattaaattgtacggcttttaagatatgtattctgtcttgcctaacaattaacatattaaagaagaacaagattaactacttagattcactttttaaaatgtgccgaaaacaccttatatttaaacacgatatttatgcctttatttttgattaccatctcgttccaggggaaggtccaaggatgtatatccggggtaagggcttttgctcaagttgtggctccatttgtatatagtccattgacaggtaagtgaacacagtatcactaagtgaccaatgaacaccattcattaataactatcattaataaaacgttattcatcactaataagttttatagcgttcattggtcaatatcgagaaaataaagttttatttcctttaacaaatatttattttggtttgatatagctctatttctctccgaaaatgcaccattctatttccctggattcagcattctatgcatcgccatctctttggtattctttacatctacaaccatatcatcagttatcacaattatatgtttattattaataatgcatgacataatgacattgctttacatgcacagatgatcggattccttcagagtcttctgataaaagatcatccttctttgcccttagtgaacataacaatcaacaacccttcaaaagcggaagcttgacaagaaatatatcaagaagcaaatgtaactgtaatattgtacaaatttgcttcaaattaaaagttcatttaaaacgaatacatagctagaagctgtaaaaataacttagttttcttacaaagattgtcattgcaaatgaataaaatcacttgtatagtagttgttggcaactaagtacaaccggtcacatcaacatacatcaactaagtaaccaaacaaatataaccgtaaaaacaaacaaccgtaaatattttagagaagagatgcgataaaaagacaaccgtagaaaaataaacgaaaatatttcaacaaaagaattagatgaaaagacacaactgaaaaattaaccgtaaatattttaacaaaatgttgcattgacacaaccgttcataaatgcaaaaaggattgggataaaaagacaaagctttttatatttcaatgaaaagatgtaataaaaaagacaaaacaaaaaaaaacgtaaatattttagtaagaaattgcgataaaaagacacatccgttcgtaagtaaaaagacattacgataaaaagacacaaccgtaataaaaaaacaataaatatattaacaaaaaattgcaacaaaaaaacacaaccgtttagaaatgcaaatgacattacgataaaaagatgcaagtttcggggagaattcgcaaaacttcatgaaaatacgcgataaaaagatataacaaaaaagatcgtaaatatttcaacgaaaatttttcgttaaaaagatacaaccatttagaagtgcttacgaaagaaacgacacaaccgtaaatattgcaacaaaaagttgcgagattaaaagaaacaaccttataatctctttgatcatatgaatggaaaactaaatctttgcacacaaaaaaattcaggattttcatattattttcatgggatttttgtttaaatgggcacatttcagccaaaaaaataatgagagggtacattcttgtgggcttataagaatgagtacttatttggctaagaaaagacaatcttgtcaatactctttcttctttctttttttttttttttttttcttttttttccaaatgcttcatagatctttttctcccttattaattcaatagatccaattaaataggtttgtatataaataaatctatatcctaagggaataatgcttagggaacccaaagatttcaagacgcagattaaattaattttacatttgatcgataaatatattggtcggtggattttgattcggactgaaacttgtcaccagtttaggagtcgaggaaagagatgaaggcagtgtcactggtttttgattagcaaagactgaagatggaaggcgttaacggcggaaatgaggatcgacggtaggatatgttttcgatttgatagaacgatgtctaataatcgctaagtaattcaaaaacagatgttcgatggtgtatgtgtcatgttgtgatcagtttacgaattacgattagggtgaattgagagacaaatcggaactggagattgagggtgaattgtagagacaaattagacggttaaatgcgaataataaaaaagataaaaacgtcaatactgtgagaaaaatacctaattgcagtagcacatgattttgtgcctatttctacaacggcatacacttttgaagtgctttatttgtaactgatccttattttcatgcatgtgagtgatatcaagttgtactttgttgttttgaaatgcctagaaatgacaaaagcgtgtgggaatggacataatcgtttttacaaaattgtgggaatggacatgatccttatttatggtttgtacgcgacggataaatttttatttaattacgtaatcgtctggatttatatatctttaatgcagattgaaatatggcagtaccaaattttttgcatagtcttaacttcaaatcgatcgtagttattacaaaatgtcacataattcgtaatgtgtaattaaaaggtactccctacacaagagatggtgactaatgatcgagtcggccagaaaataccaaaaaagtcctcaaaagtctgatgtgatctcccatgcttcaaccgaatttttggaataaagaatagattggaaaaatatctgccacattgtagtattttcaagtaagctttctttgtttgttcaataatcaaaagcaaaaacaaaaacaaaactctcaacactttttgtgtttattttctgttattttgaatcgaagtcggcaagcataggctaaaaggtg

SEQ ID NO: 375 - DNA, 3000 bp, Arabidopsis thaliana
tccctctaccaatcaccaccaaaccattgaaacggagctctacaaatcggacacgtcagcttataaaaacaccacgaatctatacaatccacgtgaaacacgtgcttgcatctcacaagaactctaacgacgtcgtttactttaaaatcctccaaacaaatcacacacacgtcagctttaactccgtcaccgtctccgccgtctccaccgccgcatttcgtgagtctcacggcgggaggtaatggctctccggcttcctcatcgccgatttcttcctttggtagcttcgggtacattacgaaacagaggagaataatagaaccgtagaagaggataataaagacgacgcaaagaagtctcaacacgattgattctgatcccatcactgtcgacatctccggtgacgccgccgccacgtaatccccacaacaacttgatgccatttttttattttaagaaattaaattggcttattggaaaattttgtgaaattgatttgagtttattgaattgtggggatgcatagtgatgttcttaaatatggattttttttttttttgttatagtgttaattacgattagtgtgtgatgaactggtgaaaaactgaattaacgcaatttagttatagttatgcggagaggaatgtggcgggaaggattaagaggagaatattcgagctaattaaaattgttaattggaggttaatcataaacaagttatgagtttttatttcattttattatttgtcatgaagataacacaaaactaactaaatttaaattaagctaatgcgcagttttgtttgttttttatctggagttttttttgtttcagttactatttgatgatggatgattacagcagtaaaaaagaaaaacacatattaactactcagccaggcccagcccaaatccctctcaacgcagccaggcccagccgaattatgtgacaaaactaaaaatgatgaaatacacaaaatttggaggatataaatgtaaaataacaaaagctaaagggcggttccaactatttcccaatctttataatataccctcgagactttccaatctttcctttttgcctcagaggccattggcgaagaacaaagtttgaaccttttcttcatccatctctctccgtcgcttcttcctaacgattccttcactcgaatcaggtaaactatttactcttctctttctctttaggatcgattggaaccctaggatctctgagtttttctttcacatttaggatctatccctttaatcggcaaattagtatgtgagcttttgatgatttggggcttgaaaccctagatttcagcttaatctgggtaatttcattgggttgtgaaatttctgtgtaattgtattttggagaagatattgatttggttaggtattaatcaatctatatttctctgttattggtttaggtttgtgaaggttttttctagggtttcgaaaagatgccggcgacagcaggaagagtgcgtatgcccgcaaacaatcgggtgcatagtagtgcagcgcttcagactcatggaatatggcagagtgcgattggttatgatccttatgcaccaactagtaaagaagagcctaagacgacacaacagaaaaccgaagatcccgagaactcgtacgcgagttttcagggacttttggctcttgctaggattacgggttcgaataacgatgaggctcgtggttcttgtaagaagtgtggccgtgttgggcatttgacgtttcagtgtaggaatttcttgagtactaaggaggataaggagaaagatcctggtgcgattgaagctgcggttttgtcggggttggagaagattaggagaggtgttggtaaaggtgaggttgaggaggtgagtagtgaagaggaagaggagagtgagagttctgattctgatgttgattctgagatggagaggattattgctgagaggtttgggaagaagaaaggtgggagtagtgttaagaagacgagttcggttaggaagaagaagaagcgtgtttctgatgagtctgattctgattcggattctggagataggaagagaaggcggaggtcgatgaagaagcggagttcgcataagagaaggagtttgagtgagtctgaggatgaggaagagggaaggagtaagagaagaaaggagaggagaggaagaaagagagatgaagatgattctgatgagtctgaggatgaagatgacagacgtgtgaagagaaagagtagaaaggagaagaggagaaggagaagccgtcgtaatcattctgatgattctgattcagagtcttctgaagatgatagaagacagaagcggaggaacaaagtcgcagcttcttctgactcagaagcaaatgtttcaggcgatgatgtttcacgcgttggacgtggttcttctaagcggtctgagaagaagagcaggaaacgtcatcacaggaaagagcgagagtaggaaatcgatctatatgagccattttcactctccatttctctcttatcaatgttatgtacaataatgaaacatgtctttgtatgttggatttgatttgtgttgaaacatgtctttgtattttcactctccatactctggtttggtctgtttgtttcaagcttgtgttataacactattgagatacttggtgttaatttgtgtctttttactctattccattatttacgtcggcaagttagagctcacgtcggcaagtgtcgttgtaaagagatcacgagacttgtgggttggatttttggcatggctctagcctaggaggacaatgtcgtcatttaactggctcattgctcaatacatatctcgtcgtgggtccttgttaatctcttctccaccgttgaaccatagtttaaaatatccaccgttaaaagcccctttatatcccaagaaataggtgaacttgttacagaacaagcaaagatcaaagagaaaaatatcccaaaaccaaaaacagaggaagaaagaagaagaaaag

SEQ ID NO: 376 - DNA, 3000 bp, Arabidopsis thaliana
tcagcaacaaaatggattctttacacgttcttagatcctttcttcttcttttcattgtttttaatcatcttcctcgcacaactacatcaatgtcagaaccaaaagtcattaccatcgatgtaaaccaagctcagaaacttcttgattctggctacacgtttcttgatgtcaggttaatcttaaaacctttcagattcagtcatgcctttattgttgttcgatattactgtctggtgatttctgaaattttaagagctgttaaacacagaactgttgaagagttcaagaaaggccatgttgattcagaaaatgtcttcaatgttccttactggttatatactccacaaggtcaagagattaaccctaatttcttgaaacatgtttcatctctctgtaaccaaaccgatcatctcatcctggtaataacatagtcttgtcctgatcatgtgaaagtatatttcaattcactagatcttttttttttttatgttcactggatctgaatctagaaactgttgttatgatcttgttttgtagggatgtaaatctggagttagatcattacatgctaccaaatttcttgtttcttccgtaagtaccaaaagattcaagatttgaaaaccctgttttcttctttaatctatgagtttattggtgagatataatgcgattgtttaatcatgtgatagggcttcaagactgtaagaaacatggacggtggttacattgcttgggtcaacaagagattcccagttaaagtggaacacaaggaactcaagtatgatgagctttgattcaaattcttcaaatacaagcatgttaatgtaaatttttgctttaaatatatgttaagaatgtgtaaatgtaatcatattattgcaaatttgcaataacacataaagtataaagttcaaggtttagagagatgaaaaaatgggcagaccgaccaatgaagctccagcatcgacaatgtatgtattcccggagatatatttagacgagtcgtgaacgaggtagcgtaggagagaagtaagccccggatccactgtctgttgtacctttaatgggactgtcctctcgataacggtcttgagccactctttttgcataagaccttgtgtgatctctgactttaaaagccctggtgcgatcgaattcactctgatcttgtaaacacctaactcaagtgccatcatccttgtcatggtgtcaacaccgcctttagaacaagcgtatgcgactccaccaggcacctgaccgcggtggagccaggatactgatgaaatgtttatcaccgagccaccaccacgtttagcatcgcgcattaaaatgcatacgtatttggagactaaccaggttccggttaagttggtcttgaagactttgtcccactcgtcttctgacaaatccaaactcgacttgacattgcctctaaatcccgcattgttgatcaacgcatcgatctttccgaagatttcccaagctttcttaaccgctttttgaacggtggctgcgtctgatgaaacgtctagctcaagagcttcagcttgaattccagctgaatattcgaagcgatttatttcagagcagagagatttgagacgatcgacacgacgagctgctgcgataatcttacagccagctttggctagatcaagacatacctctcttcctataccagaggaagctcctgtcacaagaaccactttgtctttaagttcacactatggctccagttgcttcaatacctgctttgttagagtcatattaaagatgattaaaaagcatatatgataaattttcatataattgagctaacacagtgagatataagagaagaagtatctcacgcacagtttgatgattactcatgttgtttctctttgtgtgttctttggtggagaaggatatgcccataacatataaagacttgtctctaaaccaaaacgacattttaacgtggcaatctaaatctgtaagtctgtaactgatttgtctatcaaccaaactttaaaaccttttagaggcaggggagtctttattgttagttagatactgtctggtgatttctggaatttgagagctattaatacagaactgtttgatgaagttgagaaagggcatgttatcagagaaactctttaatgttcgttactagttttgtgtgtgtgttttttaaaaccttaataaaaacagaggatattggtcttaatgttttttccttgaaccaatctaagttttttaatgagaattaatgggattttgtcttttcttttttttatcatgtaaagagaacttcaagactgctagaacttagaaacatcaaacatgtttggtggttatattgctgattaagattatccaaatataagcatgtttaaaatttattttgttaactaaatctaaaatcgttttttttttttttaatcgttaattattgtatgcaaaacaatttaagttataagttaagcaatgacatgttaatagttcaaactaaatactgttttacaaatgtaatagcatgttatgtagagtaaataattagtaccttttatcagaaaagaaaaaacgttactaccttctttttttttttactcaaaaacaaacaaaagaaactatcatttctttatttcagttaaataatataaagttttagtgatacgcaactgcataataaattatctttaagtacactctttttttgagtttaatgcaatttccgagacgaaaaaagcgaccgaccgacatgagaacaattaaccgtgtaacagcgcgggaaagatgtcgacaaggtgagttataaccgaaccggtttataccgttttacacgcgtcatttacgcgtaacatccacgtcttcccaaatctgacagatacagagatacttaacttggtccctttccttcttcttcttcaaatataaatatctttaatcaattcagaaccaaaccaagtcaatcattcttcattgatcttctccgatttgaaatcgccggcgaaa

SEQ ID NO: 377 - DNA, 3000 bp, Arabidopsis thaliana
ctctcttcttaaaacctcatccacccaaacacaaatgtcttgtaatccttctcttatctttctccttgtgattcctttttatattcctctgatattttctctcagtttgatctcatttgctctgcaatggcgactaccatgaatgctgctgtttctctcacatcttcaaactcttcttcttttcccgctacaagttgtgccattgctcctgaaaggatcaggtttactaaggtactttataagcttttctcaactggataatgataaagtcaagatcccacaaaaaaagttgtgtagtcgagagtctagagatgctctgcttttatggttttgctaataatcttctgggtcttgtaagtaacatgttaagtaaagttttggaatttggataaatgtgcttctgggttttctcaaatatgaccaaaaacttttggaagatcaatgtactgttgatgggatcttgattaggtctctctggttttgttgttgggtgtgtttaaaagggtgctttttactacaaaagcaacaatgtagtgacaggtaaaagagtgttttccataaaagcacaaatcacaacagaaacagatactcctactcctgcaaagaaagtagagaaagtgtcaaagaagaacgaggaaggtgtgattgttaacaggtacagaccaaaagagccttacactggaaaatgccttctcaacaccaaaatcacagctgatgatgctcctggagagacctggcacatggttttcagccatcaaggtagtgattccattacttgattctcacaacatgtttcttactttataatgattcttttcttgatggtaattgaagtagcatttatgtgtcttcgataggagaaatcccgtacagagaaggacaatctgttggtgtgattgcagatggaattgacaagaatggaaagcctcacaaggtcagactttactccattgcaagcagcgctcttggagatctcggcaattctgaaaccgtaataaaccatttcctttacaaattttacgaggctttgttttgtctggttaagtgaatgaaggagttgtttcaggtttctttgtgtgttaaaagacttgtttatactaatgaccaaggagagactgttaaaggagtttgctcaaatttcttgtgtaagtactaatgaataagtcttgtgtaagtttataacttattcacttattcaactattgtgttttcttttactttatttttcaggtgatttggcacccggaagtgatgttaagctgactggtcctgtaggcaaagaaatgcttatgccaaaggatccaaacgccaccgttattatggtctctcccttaaacctcaaatatcttgacttgcttatgactaaacctctataggttctgtttcttgaaacatcattaaacactagtaaacatccttcttcttcatgaacaccacagcttgccacagggacaggaattgctcctttcaggtctttcttatggaagatgttctttgagaaacatgatgactacaaggtaaagtaaatgattatctttttgattttgaccaaaatgtattaaaatctaacatctttgcaatcgttggaatgcagttcaatggcttagcttggttgttcttgggtgtaccaaccactagctctttgctctaccaagaggcacacacacgctaactcttcttctggtttcattcttcaaatccttccaaatcattaagtaaaatcaatcctcttttttttttgttttgaaaatcaggagtttgataagatgaaagcaaaggcccccgagaacttcagggtggattacgcgataagcagagaacaagcgaacgataaaggagagaaaatgtatatccagactcggatggcgcaatacgcagctgagttatgggagttgttgaagaaagacaacacttttgtttacatgtgtggactcaagggaatggagaaaggaattgatgacattatggtctcattggctgcaaatgacggtaagaagagctaattaataacactccaattcttgaaacattcattgcataagcaataacactctaatgactttgtggtggttttaggtattgactggtttgattacaagaagcagttgaagaaggcagagcaatggaacgttgaagtctactgatcaaaaagcctttgacatttctgtagcaaagtatagctgaacaaaactgtaattttcgcttctgaatttctgtattttgaagataagttttttagatatgttatactaaaaaaagagttctttaatcattatcatttacttcttcccattattttgctttaagttaaatgacacattgatatttatccatctaaaaaaaatgtcattttctttaactaattgataaggaaaaaaacaaatggttaatgaattgccttcagttgacagcaatctgtattttatggtagctaaccaatcctttaacaatatccaatcttattcttttatgcatctatttaaacaaagtaatggtttcttaggacacttgaatacttgagtcgttagttgattttgggttggactactaattcatgaaggttataatgttacctccaactccaagccataaaatatcatgagaaaaagaaaaagaatctcgattgaagatattttcaatttctatgaagacaatagtatggttgagatttttacaatttctatgaagacaatagtatggttgagattttttcttgaagccgaccaaaaaaaggagaaatctagcaggctaatgtttattctctcttttctttttgtcagaggctcatttgtcagtaaccatttgatcaacggctaaatcctatatccactaaaattcaaccacgtcatcagacataccaatatacagcaacacttgattgtagctaataaaaagatcgtcaacagaattaactctttaaatcacttctctgttatacctctctgtttcgctccctgaagaagaagaaacagagcgttcagatttctcttcaacataatc

SEQ ID NO: 378 - DNA, 3000 bp, Arabidopsis thaliana
attttggcggcccatctattctcttccctctttctgagtagtttagtgaaacagaagctgacaagaaaaaatagaaaatgccaggaaacacacagttagcagtaggaagactcttataggtcaacttctgtagtggtagtgcctataaatatccttgagttttttatttctatcactcattgagaatcaaaaatcaaaatgtcttctcatactgcaactaagtatgatgttttcctaagtttcagagggcatgacactcgccacaacttcatcagttttctctacaaagaactggttcgaaggagcattcgaaccttcaaagacgacaaagagctggagaatggccagaggttttcgccggagctcaaaagccccatcgaggtgtcaagattcgccgtcgttgttgtctcagagaactatgctgcgtcttcttggtgtctcgatgagctcgtaacgatcatggatttcgaaaaaaagggttccatcaccgtgatgcccatcttctacggcgtggaaccgaatcatgtgaggtggcagaccggagtactcgctgaacagtttaagaaacatgcgagtagagaagatcctgagaaagttcttaaatggaggcaagcattgaccaattttgcgcaactctccggcgattgttcagggtgaaatttcgtaacttggtgataaagattgattttttttagggtttgttaagatttgagttgaatcaaaaagattgaatttttttattgtttgatttgaatcgatgctaaagtttggatttttttgttttgtctctgtagtgatgatgactcgaagctggtggacaaaattgctaacgagatatcaaacaagaagacgatttatgcaacaatatgatgagtccagacgagaagaagaagaagaaaggagaaggcccataaggactcgcatgcccaatccaaagtattcccaacactaagtcattttacttagtctctgttttcgatttagttacaataagcaaggagtcttccacgattacagtttccatcttttccaagtttgtagaagttgttactccacgtttgtttccatgttgtttctagttgtaaggaggtgtactccaagtatttatatcaatgaaaaacaaaacaaaaggtagtcttaactaacaatcgtttatcaattctaagaactagaattctctttggttttgaagagggaccattacaataaacaatgggaagaatctagttgggattgatacacacatgaaggaactaatcagctctagctaaatatgtttatcagacatcttgtcaacagtttgacagccattgttttcttggaaacgtgaaaacgatttctctaccaagtgtcgttagctcaattggtaaagaccttaagcgaaagcttcgcttagggtcgccggttcgagtgacgcttgagacgaaactaatattacatgatgtggtttcgggtctgggtggattacgggtttcgttcagaacctcctggatttcaacaaaaaaaaaaaaaaaaaaaaacgatttctcagggtcgccactcatctacacgacgagttttgagaaatattaaaagagaagactctaacaaacaatgtcttaagaatcaaaaggttctgcttgtggcagacgacgttactaaggttaaacagttagaagctcttgcagatgatttcagcagttttggtcctgggagtgttgttatcatcactacagacaacaaggggttgttgaattcttatggtataaaagaagtctacgaagttgagaatttgaagttttgtggaatcttacgatcattgggctttaaaaagagagctgctgcgttccagcgggctttgtgtagagcaaatagttttgccacggaatgtttttgttgtcaaagtagtagtatatctggttatgggaaagtgacagattcagttaattaagtttaaattccttagtcacatgcactaagttagctaaacttaataagatgtgtggctaggggtgtaaaacaaatatcactcttcattaaattaagtaatatacacttttttttccttatcaaatctgtgtttgagttataacctaaatgtttgttgtgtgtctctttcaagtctatattttcttaaaaacaaagtttgtataatttcttgggattcccatgaccatttgttctttgaatacccgaattctcaaaggcagtttggttgtcaaataaagattacacaatttataaaaaaagatttgtgtatttgggagggtttttgatgtttggacatgcccaataaaattaaaaattaatacaggagacacaaagtcgcaaactttccaaagttggaatctacatatgtctaaaacagagaagaaaagcttttaaactttttacatgatgatcctccaataatagtaatagtgtaatggtactatactactacagttcaaagccactgatttatgctttttgggtacgtggaagatttcaatcacagacaaacgtaattaaatcatttattggaaaatgtgagtcaagctgaataaacttgatgcacacgaatagatatgaaagaaattgggttgatcaacaaaaaaacaagccgacaaaaactgaatcttatgatcttttttcgtccgtcagtttcaaccattcgtttgatcggataatcaaaaccagcaaatgccaataatacacaccagaaaaggtaagatgataatttttgttcgttagtagtattttattattatcatgctcatcattttcttactttggcggcccatcttttctcttcccctctttctgagtagtttagcaaaacagaagctgacaagaaaaaaatagaacatgcctggaaatacacaattacaccactttagcaggaagactatgggagtctctaatcaatgcacatgctttattcagttcaactactctctagtggtctataaatatccttgagtcctttatttctattactcatcatacttaagttctcaatagagagaatcaaaaatcaaa

SEQ ID NO: 379 - DNA, 3000 bp, Arabidopsis thaliana
ctttgacgcctccggtcacggtacctgcgtcaccggagactgcggcggcgttttaaaatgtaccggcggcggagttcctccagcgactctagcggaattcaccgtgggatcaagcaatgccggcatggatttctacgacgtgagcctcgtcgacggttacaatgtaaagatggggataaaaccacagggaggattcggaaattgcaaatacgcaggctgcgtctcggacatcaacgagatttgccctagcgagcttaggatcatggatccgaattcgggaagtgtcgcggcgtgtaagagcgcttgcgcggcgtttagttcgccggaattttgctgtactggtgctcacgcgacgccgcaaacttgttctccgacgtattactcgtccatgtttaagaacgcttgtcctagcgcttatagttacgcttacgacgacgcatcgagcactttcacttgtaccggatctaactacttgatcactttctgccctacccagtcttaaaaccggagctccggtttagatttgggttgggtttctctctctcacgtttcttttgcttgttatgtacggaaagagaaataaagaaagatatgataaggaaaagcgactatgatccatttttaaagattttttccagtgttctgttgttacacacacacacacccatctcatttgcaaatttgcaatgttgctttgattagcacaatagtatattgagactaacatatcaatatctggattactaaagacagatgaatgcttcattagggggttaataattgtgtgtttcaggtcattggttctcttcttcttgatatacttactaacatgagagagcaataaaaacttttagttcacccaaaagagacagagctaaatacattttcagccacggaatggttaaaatatgtgacccgcgcacagattcgataaagtctacaagacagcttgttaatttcttaaggagatcgtactaatgcagttaatatatcactagtgtttattgcttattttggtttccacttgtaagctttctttattcctgtggcagcctaaacgaatcctacaatagcctgaagctcatccattttctgtaaaccagagaatgtctcataattcacaccactgggcattgtcttgcaaatatggatagaccagtaaccctcattttgctaattagcaatgcatggatgtatgaaatgtttattgaatcaggttagatggttcaaagtaggttgtattgtcggtcttagtggaacttggttcgagatagacataagaaccattatatatttatctcggaggtgtattatattagaattagaatctcactctaaaagttcttggacggagctaaaataacatataagagacatgtgcaaatccattcaaaaccaataaactcttcaactgtattataaatcttacaactattaatgtctaattttagctattgccactacggtctaaaatcttcgaaaccgtgtggaccatataaccctgatgagtgggactaataagatttttaacattaccccttagaatagaaaggtcctatgctatgtattagtacaaggaaatttcagcagccacgtttttttaccacaccactgcttatactaattaggaggattacttagcttggtttaagggtttagtaagaaaagtccatcttcttcctctctgtacgccctttgaatctcatctcataaagagacaattctttctagctcccatcacccttttgctgattgctgattagttttcccttttcatatcagatattatatttcgagatttgacatatataatacaatgttttcgataaactacaaaaccaatttcgaaaaacatataagttttgctggaaaaagccgtcgttgatcaaagccacacgacaggttttatgcctaacaacgttgacccattaatgaaaggactcaaaagcaaccctcatagtcacggcaagattcaattacttttcctcggacccaaagttggttcaatttatgaaccagtttctacgtctaagtcagtcgtctcaccttataatctttaaagtctcccgctgcactaatcactccgtttcatcgttttatatatcacttgattttattttatttcataaaatatttttttttaaatacagatttttcttcaactatgttctagacttctagaagccataaaagattacaatattattaaaatgcgggacaaaactacataacgataccatttaacgtacgaaatatttctaatttacctattcgtttataaccagattttatacctgtttagatgtttactgttttaaaaactacacattcatggtcatggaggatatgatatctaaaaccttaggattcaagctttcgcgttcaagtagcaaatcaggcctcttatgtatgcatctgttccggtcttataatcgaggattcacaccaaattaaaaagcatcgatctattcgggtttcatacaatcatactcatgggttacaacagtcaacaaacacatctatctggtcatctggatctcaaactcgcacctcacaacacaatatctaaccgatccggatctcatattcaattcgtggatcacaattagacacatctaattggatctcatagtcgcggatcacaattaaattcatctatacagatatcatactcgcggaccacacatcacatgacataaaacatcacactgaaccctaaggtttagtgtagtgtgcatcagccatggccgagtcaaaatgttaagattttttttttaccatttatagtaaactaatggaagtaaaaaccagtaatgcaaagaaaattcagagaaccaaaggaaatatctatcaagacaccaaaaattctaattgattaatcatgacaacattacgtcgctacccctcgaaccaacatctataaatagaggatcggtgccattaacattcatcatcatcacccacagcacagagacacacacaaaaaacccataaaaaaat

SEQ ID NO: 380 - DNA, 3000 bp, Arabidopsis thaliana
tctattagcttttacagaggcctgaaaaaacttagagttcttatccccacgagacatccatttatccctgcttttcaacctccaaaaagattcctcctctctaaaagcaatacccagctgattttgaataacagaaatcttattccaacaaggaaactggtaactcttttcttcatccaaatcaaatcttaactttttaattcgactctttgcgttataatcctttccttttttccagtgactaatagatgacctacagtcaaccagacggcgcatagaagaaggattatgagaagaaaaattacctatccatgctttgtgaatagcagcttggtataaagggtcttcagcataccttttatcaaacctgaaagttcctcggaaaagctcatgatcattaacaaacttcaccaaaaccggtctgtgatctgatccaagtttctccaaaaaccattgatgagaattaggaaacaaagaaaaccactgtgaatttccaaaacagcgatctaatttacattggatccattcttcatttcttttgcctccccaagtaaaactatttccagtgccccccaattcatgcatatcactggttgatatcatattcttgaagtcctgaaaggaagattccactctagatgggccacctattttctccttattagacaaaatatcattaaaatcccctatcaagcaccaaggagctgttctgttcactccaatgttactgattttatccaggagcaagtgtcttagcctctgtcttggattatcataaacacaagagataaaccatctcttacaaccttgagatatctccaaatccagcaagtttttgtcttcaacaaggaaatctgtatgaaggtgatgtttccaaaatattgctaaaccaccactctttccatccggttcaatagtatgaaagtaatcataacccaaccacctaaagactttcaatatgaacatgtcagaattcatggtctccatgaggaacaaaatgtcagggaaatatttctttttcatttccctcaagtgtcgaattgtccaagaattcctcagtccttggcaattccaactaaggatgccttattgatactgcggtggttcttgaggaaccaccgtaatgacagccttttccatacaatccactctttccaagtctgcaatttccttttttcgtttgatagcattagcaaactcaacattaagactaacctctttttcttttgaaccatcacgagctgcttgcttattgtgaactatagaagcctttctttttcttggattcttctgcttaatacttaatcctgatgcccccgattcattaaatccaaaagggaacccttccgaatctattgaagatgcttgatcagcggataaagaaggtaacttggtaggaacaatcttctctcctggattcactaaacaactctttccatcaagaaatcctgaatcagaaaaactaagatctttctttgattctttagagtttccgaggctaacaaaggggcaaacacttttctcatgtgtgagtcgttgacagaggaaacatctttttcgaatcctttcataatcaaaggaaactgaaatcaattcacccgatggaatcaggacttccttaaagttacgcaagggattccgaacatcaaagagcacttgaaccctgatataattttgtgcctgagatttttctaaatctaattccacagtcaatactttcccaacacatcctgcaatttctttgatagtatcttctgtgtagtagttgatcggaatatttcggagtcttatccagactggaagaaacaaaagagaatcatctgaaggtttttccacccaacgctccatcaaaacacaccactcatcctgagtccaaactccagattttaagatttcaattaaatcttcttctgatttgaaaaagaattgaaatctctcttgggataaagcaacacctcttacccttgaatacaacctccaaattctaggcatgtctaatatccaattagacatcctttggagtgacagattcaaaaacctatccactaaactgcaattatttctgtcaatcgagcaaaactgcgcttgattagacaaaataagaggctatcttcgttaattgacatttcctttatcgcttgatccaagtccatgttcatctccactgatagaagaagaaagcactttcctgatacctaaacttggtgaatatatctttgccgacagaaaacggggatatcttcggtacttacctcctctcaaatatcaaaaaactgatgtagagggagaagttcttatggtcaaatcgattgggacggctttattaacggcgaaggagaaattttccagaaaagctactatgaaagagaacagagagtttttttttttttttttaagtactattggagactaattattcatagtagttaccatttaaacacgtaatgttttcatttagatacgataaaaaaagttaacaaaactctagtgtccttgactacacttttcttacttttgacgtggtcactattattgtggactccccaatatctgactaactcaaattttacctttcttcatacgttttttttatctgtttgttaattaattccagaatgagttgtcaaaccagtaggatttctctgcatgtcgtgtcacttgcattttaaggacagattaacggttatgactagggtcggtaaagcaaataaatcgacaaaattagaaaacaaagaaaatgtggaaaaagcagtcaaaagaagaaaaatgttgacaaatgttacgaatttggtttaaatcaaaagtgaattatccgagaaagatgatatttacccccaaaatatctaaacaaatacttaaaaatgcaattctctaatagactatcaaatatcccgatacctctttatatagtgccatcttcatccttagtaatgtacacacacacacataacacttatttccaactctgtctctctcaattttctttctctttctccaaac

SEQ ID NO: 381 - DNA, 3000 bp, Arabidopsis thaliana
gtgcacaaagttcctcagttttttttcccaaacaacaaccatttcagaaaatctttcttcttagaaattttatttcccaatttgaatagaaatatagatggaatggaaggcaacgacttgaaataataaagataaggttggacatctaaagcccataaaacaaagctaatccatgtaccattgtcatccacaaagcgtctccacctaaagcccattttggatccaaaattaaatttatttgtaagaaacaatatttctattttgtcattttacttgctgatcaagagtcgaaaaagatgcacgaaaagaaacatacacaagcgaacacaatataactaacactaataggtaatagtttctgacacgtgtaggcataataattggtggctacgtccctgcggcggttgcagtaacgataaacactccaccactaagagcgtctcatcacacgcgccaatttcactcttacgatggagataatgggcgagtgggatagtgtatcacgtgacattcgcagacacaactcgcttcataactgaaaaaattaataataaaaaatggatatgtttgtctttctctaatgtttcatgaacatctgtaacgtcaaacccactttaaaagctctgctttttgtgtttgtttttgcttactctcaaagaaagtggttcaatctctcgatttccatggcgaggaatcatcagttccgtgtggatttggaagaaatggggtttcgttctcgttctcatctgttcctcaacgagttcgaaacgtctgccggaagattcaacttgctcagccgtaaccaccgtgatcatctgtacgtttccgacgttgtggatacactctctgaacagttctcttcgatgtctcttctccatcctaaacccagactggttcctactttgccttcgagtctccaggtcatttccttttttcctctgtttcattactctgttttcacattttcttcacaagtttcatgtttttgttttggtgtgtcttatgcagtcttctttaaggcctaatggtgttaaagcttatcagagattgtaccgagaaaggctcaagcttgaacctttttatgaacttcatctttcaaggatccgcaaagaggtagtcaaaatgcaaacttttcttactactctcttttgtctctcctttatgcaccgtttgatgttttttattttgagttggtgattgcagtcacagcaagatagagctaaggttttacagagacaagaggcacggctacagaagagaggtttggttcaccgaaacggtaacgttttgaaggaatctgtaggaaccggcgtttttcaccctcttcagcgtccaactttcaagacttttgaccctgtgaagaagcatagtaagctacttcacttgtcttcttccaaaaccttcttttatgtttaaaataaggtttggtttggttttgttttcttctcttgaaattctctttagttactgagactagctctttgcatgttttaggttagtacacaaaatggaaaaaaaatctgacctttttttgtttacttgtcgaaagcagatcaaaggaatcggaatcaaagtgagaaggagtttatgaccaaagaaaaaagaggagtgatgacttctacaacgcaggagcagcaacagaaagaggagtgtcattatcatttgccttcagacatggatttctccaaggactggactttctgatggaacaagttcaagtagttactaattattagatcttttgggtattaagtattaactaggaggtaaataataattagggacaaagtttgaagatgaccaagtggattaagcttgatttcaaggtctagatacctttttagtatgaactagttttttggtcaaacagcttgtctcttatctcaatttccgaattgtacttaagtttcagtattgttgttatcctataatggtgggctaaatccaaaattcccatactagcaatctagcatcatattatggtggtgggctaaatccaaaaatcacatctctgttcctattgggccatatatgttcctatatccaaaagaattggagttgattttcttttctattttcatggtcacaaaacaaatttccttgaccatggactataaattacattctaagagattgatttaaaaatacatattaatatacatttaatactgttgttttaagagccaaatatgagaaaatgtttgaatatctatcaatcatacaagtgcaacctatgtaagcgattatcgtttggacattataatatcgttttgagcgtagacgtacgtccaatgctgattatggacccaccaatactaaatattgaaaatgtgctaatcttttttaagttaaaattttaatattcctaactctaaagtaagatacaaagacaagtcatttagtcgaaatgaaaatcaacgaacgtctctaatctaaaattcgttttctctttatcaattacaaggtgatacaattatgggggaatcttgcaccatattaacaaaaatggtagggtagatgaagccacactagatttttttttttttttttttttttgagcaaaccacactagatgttaaatagcataaactttaagaatactgatttatgtccactcctttgtttcccctacaaatcatatccatacataatgtatgctacatttgttacataattgagtgaaaagttaaaaactcattcatccgtatacatttactttctccatgtaactttttgaatgcaaactatcaaattagaaattgatcaacaatcaaattagaaaatcacatatttgtgaagtattgattcattattttcttacgcctaagctaactgtaatttagaaataaaaaggtggacaaaggcacaaaactataccacttctaattatcaatataaatactaatcatagtctcactctcactttctccatcacacatacatcttctccatccattacacaacgaagcatagtggcaaacccgtaaatacataatacca

SEQ ID NO: 382 - DNA, 3000 bp, Arabidopsis thaliana
cagcacatcgattactcgagatattgtttaagagttactactctctttggataatgaactagaataaaagataacattctctcttaagtctctatttatccttccttgcactattgtagttgccttctagcagttgaggaagtagctcggtaaacaaataaaacgattgaaaacctacccaagttcttgtaaagtgatactggtctatgatctgtaagaagctaacttgttacaatgctttcttgtttgtaaggttggtgctaaggatcaccagagatttcaagcatcatatgccaccattcttaaggcccacatgactgctttgaagaagagggaaaggaaagaccggaagaaatcgacagaggcagagaagaaagaaagcacttcaaccactaaatctaagaaactttgatttctccttttgtgtttctcattgatttgcaattgctgcttaagagttgaattttgaaagctattgaaagatctaaaagattttgacttgtgttataatagagattttggtttgcatttgcttttccctcgagaatgttcatcgtgtataaataaaccaattccatacaaatgtacgaacataaatccaattcaaagaaactgattctaaatttcaaacactaagaaaaaaaactcaattgttattatggatctcttcctgttcctaacctagtaagatacctcatcagaatttgattccacataagcttcatcagaatttgaatcaacataagccttgataacacgtctgtacttctcagggctatcataccaggttggtgtgttgatgatcgccttttctagccaatactcatcatacactctttgcctcgacatcttctccaagaatccgttccaactatccatggctcgggtcaatcgaacagtcttaggtcttcccataagaaacctaatgtaatcccttgcaagcttgaccaattcctccccagtgataatgtatgtgtactgcaaaaacaaagatatattccatcaaagcaagatacgatatttgaagttcaaatctttcctgaaatttgtgtcatttaccaaaaagatgaagcctaaggtcgccaaaaccacttgcaaagtttcatctgcgatcccagcaagaccaccatcttctcctcctgacccttcaggacgctcctcaccatttccaccaccgccaccactgcctcctccacgtggaggcatgttgccgccactgtcagtatcataaaagtctttcttctgtatctgctctcgcaacatatcttcaaccgatttcttccccatagctttctctattgctttccatggcgatatctgataacaaaattcattacaacaatcactaagaacaaaattgaaaaaataagaagaacacacttatcatcagcaaacagaacagcaaagttcttagaaacaaacacaaaagaaatcactctccagttgcaaagtaaattcatttacaggcagaagaacttaacatgaggaaaaagcatctgacctcatcactaccatcaggtttatctttcccaccaaataagcacacagcagaactttgtttcgatttcccagtaggtaaacgacggcgatgatcaagaagaggcgaaaactgagtagacactgcagcagtagctcgaagagtaaacgaggtacgcgggaagtgatcaaagcgtactgaagacctaataggtacactggagatgcaatttggtcgtgttatccttgcaggatagtaggatggtcgaaaacaattagcctgagtaaagctcatcttttatcccaatgtttctcttaatgcaatcactttctgaaaagaaaacaaatcaacagcaaacaacgaacacaaccaattagaacccaacattgaccaaaacaaggattcttctgggcatgttcagaatttgagtatatccatttctaatccaaattcggagaaaagaacaaatctttgggataattatatcgtagtcatagaacaataagcaatataagtaaccagaaaccaataacttcgaatgtgatagaatataaaggcactggttcggtaaatataaggtaagaacactgagcaagctcgcaagaaattggaatatcatagagaaaggagagtaagaaaccataaatctaccttttcgaagctttgatgagacagagactttcgaaaccctagtttcgcttggagagaaagaattcaattttttttcccctttgcgtcgtcctgaaacacaacggaggagccgaaactctgtgagagatgaagcgatcgacaaaagtttttatctatcttgaaagatgcagcttaacggcgtcgtttttcacttgagctccgatggttctagagtctctagaccagggttggtaagactaaaccgctttttattgatatgctggtttaattttgacgcatgactatttggaaattgcaataattgagttggatttttctaattttggttgattttgatttataaatagaaacattttggcttcactagtcatttttctcacaattccatacaatttttgttaaaaatcaaagtaagactttaaaagaacgttctaaatgctatattagttgaccaaaaaaaatgctatattagctaacaatatcgtttgagctaattaacaaaaacttggaactattcaatagaaaaatctcaaacgtttgaactaatctaaacttgattatctcaatcaagtttttatgagaatgattttcatccaagtaacttggctctttaaaattttgattacatattcgtttttgatctgatctatgaccgacatggaatttctcataacgacaagagaaaaaactgtgtcattgacttttgttaagtggtacaaagtggcattgactttgactcagaaaaagccaatcaataatcgtgaaagatgtctaacactgatcaatatttcaatttgaatagaccaaatttacactataaatacatcaacacaccttcttcatttcttcacacaacaccctccatacacaaa

SEQ ID NO: 383 - DNA, 3000 bp, Arabidopsis thaliana
acagggtttggaggaagatccttggctttgacgacccgaacatagagataaaacatttgctcaacaaggtcatatgtgcttgcagctcgttcactgccaatccatccggttcctccacgctgtcctccatgtggccatctctctccaagctctggtttcatgtctttaagcttatagtcttcttggctcttagctccatctttggctgccatggttttagattacttgaaccaaaagattctcctgtttctttcaaaacgtttcaattctgttcctgacatacaaaaaaacagaatctgagaattgcaggaaaaaatgattagacaaaacctgtttcttggatgtaaagaaactaatgtatctcatcagaactgatttaaaacctttataattagtatttagtaatttactttcaatctcaaccaagataattgaaaggattcttacctgatttaaacaatatatactaagtggtcgacgcaaatataagctttgtctcttggttctgttccatgaactcattcaagtgtttgcaggaaaacacagaatgtcttgaattatcttttgcaaatgaaaagtaagagaaggattaatatgaaaacgataaatagagagtaaatgaagagaaaaagaagatagcaaacaaaatcaatgaaagagataaatctatagtattcgaacttacaaaaaaagagagctatttttatatggaccaacaatatttcaagaacatgtatatatgtaaagaaggatgcgtttaacttagtaagcagtaccttgagaaagatgttgaagaagctgccataaaattctctgtttgctgctgtaccatagaaatgaaaaaaagaaagaaagaagaatttaagaaaccaagaagttaagagttattccataatcaaatttttgtttgatacacagagagagaacgaaagagaaacaattctatctcaaagaaaaagaagaatcaaaatgaaaaaggaagaaccctaaaaaattacttcttattctctctgtttttctccttctttaagagggaagctgattctttttttttgttatcttcgttttattaaataggaaagcagattcttcgtttgtcttaagacttttaggtacattaagaaatttttcagcagtgacaaaggtagaaatagtagattctctcacacttgtaaaaaattacaccacatatttgccaaattgcatgactgatttcaaggatgaataaacccggataaaacactcaaacccaacatcaagtgaaactttctcatgctttaatcaaaacttttcacaaaaatagtttcgcatcaatatataaaataaaacatgtaaacataaatttacaagaactcacagataatatacttagtgccaaagtgataattagaaacatttccaacaccaactttcccctgtgagtatatatatctttagtgtttctttctttctgcctcattggaataagcatctaaaaaatagctttttggagtttgaaactttttcataaaaagcaaaagggcaggctaggctaaggagtgattattattatttgattgagtaacatcattaccttattatctcgccatttttatttctaatgcccgcactggagcttattaaactatttggtaaaaagaatcagtgaaccgagactaaatcgaccctaacagcagagatgaaactaacttcagttagatcgacatttccctttgtatagtatcaaacaagaaccggttcttcactccacttgcatttgttaaaatgtgtccaggtttcaaccatagcaaatgagctctcatgaggatgtagtcaatcttcttcaaaatcatgtgtttaatattttagacaagttatagatgagttctacacaatttccaataaacatttctgaggataaagaattgtttttaccaacgtagatgaatttaagttgcctgaaattcaaaacctcccaaaagaaagaataaaaaggtgtggaataagttcttgtattgtttctttatcaaaaaagttataagatggttctaacattttttacatctatgttatatgtaaactatgaataaactggaatgctttttctttttaaaacttttatgaaggctaatttgaatttttatgaaccaacttatcaagttgtaaaggatccaactttagtggtccgcttttgctgcctcagtgatgcttagtaatgatgactatattattatgttcttttatgcatcatcttgatagacttgtcacataatatccatttttctcggtttagtttggttcacaattacgatttattaatgtctaacgaaaccaaagcatttagacttggcgtgaacattagacattttacattgtggatcagatacagttgatcatcatttgtgaacataagacttgtctagtggctttcatagtgcccattataaactaattgggcctcattcacgttcattgagatctgaaagatgaattaagcccacactttggctcttcttcggtaacttattttatttatttgttcatagaaaaacagaaatcacttatctcaatagagccgtttgtgataaatctcttccaacggtcggatcgatttgaagatgaccataaactttgttcgatattttcttataaatatgaaccaaaatctaaactttctctcaaatcttatgtttgttggatagatcaattgggttacttaaatttggatgaacttttgagaagttgtattagatggtgaagacattgcctcagtatacatttccaaatgcttcaaggagatataacttgcaccggttatagcctaattatatacaacgcgtaattgcattacccaaacatattcaacgccgacatcttgactatatgatatgtattgactattattacggtccatgtggaaacagagatcaaatcgaatccgtctctctaagtctatatcactcactatatagtatgtatatgtatcactaacactttccatcaaaattcaaaaccaacacc

SEQ ID NO: 384 - DNA, 3000 bp, Arabidopsis thaliana
tcacactacttttcaacaaactaccggcttctcttatctgctctctttcctcctccgagattgtatactcatagtcggattctccagacgatgcaacgtctgaatctgatggaacggtacaccgacgccttggccttggccttgatgactttgtcttcgccttctttcttgcaggtaagcagtcatctacaaaatcatcatcatcttcatcaactcctttctttgtgtttctcacacgtctctttcttccccttgttaaacgggtttttgcaacagagcatttcttccttcttttacgcccttctccagatcttcgctttcgcttgtttcccttacaaaccttcagtgcatttttgttacatgcaatgatttcttcctcctcttcctcatctaatgagacatcttcatctgcggtaaaatcttcatcgccatcatcatcctcatcctcatcctcataatctccatcatcttccttttctgtctcgtgtgacacattgtcctgctcttccaatgccatcttcccgtcttcaccatcatgcaaagaatttgaatccacattttccacatccctctcttcctcttcatcaccatcctcctctggatagtctccatcttcatcctctatctcatagaaaactctccttcgctttcctaaacctatcctttggtgtttctctccatccaaagacccacttttcccaacagcattccttgaattccttatctcatcatcttcatcatccgcatcatcgagatccacatcctcgttgtcagacacaaccacctggttcgtctttcttgacttacatcccgtgatttttcgattaccacgaggaccagtcttcacttttggccattcaacattcctcagcatcacatcttcctcttccacttcatctaattcctcatcctccaccgcatcagacccattaaaaccatcaaaggatggctcaccgtcaacagatgaggcatactcctccttgagatcagcctcagactcttcttcatcctcgtcggaaatcacataatcctcatctgactcatctgaacccttatccttagatctaacctttctattagaatttctagcccaagacgtgtttctctttcccatatgctcctcaaaataagatatagaaacaaaccactaaggcactaatctaaatctaaactcatcaaccaaaaacacaatgattccttcagctccgtcttgttctaaaaacttatatagcctagaccaaatcacccagaaatctcaaacctcaattctcgaattcagagcacgagatctgcaaatcaacccaaaaacaaacaagaaatcaagaaacgtaattgaaaatcagaaaaggtatcgatttgattccgaccatagaaattctacagttacccaaaattactacttaaatgctagtgtttaaattccgatcctataatagaaatcaaaatctatccaaatgcagaaatcacccctggaaacacataaatttaatgaaaagagagaaaaataaaaagtcaaaacacgaaaaaataataatacaaaattaaattacagctcctataatacatacacagaagaacgagagagaagaacaattagaaaaaaaaaacgaacctccgatgaagaagacgaaacacttatgatttttccactaattttgtgaatcgtgatccttttccccgccttatttttctctctatttacaactattttttttttttttggtaatgagccaaaattggggaaaggtattttgatttggttttagttaagaggctacgcgttggggaggtgagaactttttgtgtaatgactatattaccctcgaccgcttctggtggtagttgcagctgctattgggcttttttgacttttaatatttggtatgattgcgtgagcacgtgagacagctatgctctgtggtcaagcgtaccgtaatgttttgcatcggacggttataatctgatccctggatatttttatttaatgatgaatcagtgggaaataaaacgattatgaagttactatttttagcagatgttgatttgaatgtttcagatgaaaatgtaacggccataaatatttattaaaaaaactaataaagaagaccaaaagaattacatactacaaaaccaggtaaaattttctgggttaccttttcacattttcagttatcttaatgcattttctagtgaaagtttattttatgttttcaaaccagcgatttggagcatggattaagagattccttacctagaataatatttggacgatactaaattttgtaggttttgacttgcatttttgctttatccaaaatttccattgctgttttctattagaaatcatcaaagcccatgttattattcgaccatctgttgttgatgagggttggctcaatgggtacacaagaagagctttgggcctaaggccgacaatttactttaacgaaatttaattaggattcatttcatcggcatatataacttctgccgaagaaaaaacatgaggaaaacgtttcttgatgaattgacggcaaagtaaaagatcaactaggcccgattttatgctatttaaatgtaataatctttactttgttttgcaaataagaaagcttaaaatcagggaaccgaagaaagaagtagcaatcatgatcgttaggtgcattccgaattgggctttcgttaattaaaagtgaaaatacttaagttaggcccagtcatgaaagacgtcggcaaagaacgcaaacatacaagaagacgaagacatttcatggaccataaattatgggaggtagtgcttaatggacaaagactttttactactctctgttcaacgtcaagaagacttggtaaaaatacaagctgagttgattttaatctttgtcgagttcagagtctattattatgtatataaagagattggcatgaaaccatataaccatcacaattcccatttttgctctttcattttaaaggagaagcaaaacctcatagaagtca

SEQ ID NO: 385 - DNA, 3000 bp, Arabidopsis thaliana
ttttttttttttgggggtatcgatattgatcttatgacaagtttttgtggtgtgtactaattaacgtatgagttatttgcttttatataggagttgaaacagaaaccttgaggagaccaaataaagttgatgtggggtccaaaataaaaggagttaggatttgatgaaacaagtgaaaagtaacaagcgaaccaaggaaaaaatctccatccaaaacaatatttcaaaacgtacttttgttacgattgaattaccatttgggaagggaatttctaattaaaaaaaaaaaaaaaaaattaagatggttgtgttttgctagcatcaatctcccttgtattaaacatatcgtatccgaatttggtagattaagatgaataaattggtcttactccaatagtttcgcattgatttccgtttcagtattaaaatccattgggatttattggtggaaacgggaaaatcatgtgtattttatttgaacccaaggctatttctaagcaacttcttatgaaaaatgttgaccttaaactacttagtcatgcaaaaaaaaaaagaaggttggggatgtggagaatattatttgattgaattcaaataaaaaggaagaaagttatgagataaaatgtatcagattattcaaaagaatagaccaatttgcaacattgtaatttggtttaataaaacatttggtatgttgtagtctgcacatgtataaacgtacgtcctccacataattccaaaatttgactggcgttaagaaatatctaatctagtcattgataaactactactgaatattcatttgagtgttgaggaatttgatttcaaaatttccgtcttacgaaaaataaattttttgtttgtataaccacaacaattgttagtagatcatatatgaattgtaatgaaaaattatattagtgactagtgagagttagttatttatatcttgatttttttttgtagttggtgggtttggactctttggtcaagtcaatcacatgctctacgtgattttacttgcagttcacgccggaaactctcacgcgtcgaccacgtgactagacctagttcataatttttatcgtctgaatgtcaaaaactcaaatcctcctttttataaccgttttctttgaaaacaaggtattttcttaatcttgtttcatgtcttaagactaaagatattaaaatctgattttggctctacttatactaatgtcgtattacaataactaaagtctcaaacaatattctttaagcacgcattgctggaaaaattaattacaggggggacataagatctcaataatatagactgaagatatcaacttttggctatttggagtcgttacatctacactttcaaacaaaaccaacgaacccattgttttttgggatcctacgaatcccttgtgtaaacaataattaaagacagtcctaaactaatattctcttatcaagtttggaaacattgtagctttgtgaatatattattttgtctaagaagaactttttgtttgtaaatagtttttttttttggatgtgtttctcatgaaatgcaggtaagaaacatctaatgaattagaaatagattatgaataaaagaaaataatttgtaaaagaaacaccgaacaaggagttcgtattcgtatactaattggcccgccaactaccaacaccgacatatgtgctttcggcagttttgatatcattccaaaatttcaattattatttatcaaatttattttcttggtaaaagtttaattaatttcaattatttgaatgtcttaattcactgattacaaattatatatgtaatatatacataacaatttcgttcgtggagtgttattatactccttaagcgaatctgtatattttaaataaaattttgatttatgcacacgtacatgttcaattgaaacgttttccctaactatagatgccaataaataataagttgatttttaaaatgtacaaaacaaaaggtaccgttttgtaaaattttgcaaccaaaaagtacaatcggccgttgaaaatcgtggaaccaaacactaattaaagagaagtgtgaatataatctagtgtttgcggatttatattataaaatttgtgtatcactaaaatgtcaaagcatgctttgactggtcaataagtcaaattaactaacaaaccatgcgaggcgtaggtttgacttcttaacataaatgctgactcagtttttccattccgcagctgtcgactaattggacacgcttcttccaatccctttccactaatcatccatcaacacgtgacatgcctacagtgcacgacttcacagtgatcatgtcaaagttttgtttttaagagaagaagattcacgacttcacagtgatcatagtccagttacaaatttgaatgggcttatggcctgtggcccatttaagtttgaccttaatatccatcagaaacccataccaatacgggtcataagtgcattgtccatatagtgtaccgcaatgcatgggagtactactacattccaccgacgtgcatatggggggacatggtcggtccattaatcccttgcgcatcttattccttacgcgaatacttttccctcttttagttttgtataatactttccatttttttggtattaaatttatcgtgtgactatctaaaaaggtatttaattatctagtttagctataactgcaaacaaaatatctattttcatgaatgatatatttttgaaataaaatattgttgtcatgtaacgaaaaaatcaaaaatcaagcagaagacacgtataacccacgctttcactctcactcgtggaaaaccctcacacgtacacaaaccattataaaatttaatccatttacatcgaccgacttcataagaacatcgtaatcccatccgtttatatatatattccaagttaaacttcatatcatacacacaaacctaaaacaccgaaacaaaaacaaagagatttaaacaagaagagttatt

SEQ ID NO: 386 - DNA, 3000 bp, Arabidopsis thaliana
cggtgagaagaagaagaaggagaaaaagaagaagattgttgaaggagatcatgtgaaaacagtggaagaagagaatcaaggagtaatggacaggattaaggagaagtttccactcggagagaaaccagggggtgatgatgtaccagtcgtcaccaccatgccagcaccacattcggtagaggatcacaaaccagaggaagaagagaagaaagggtttatggataagatcaaggagaagcttccaggccacagcaagaaaccagaggattcacaagtcgtcaacaccacaccgctggttgaaacagcaacaccgattgctgacatcccggaggagaagaagggatttatggacaagatcaaagagaagcttccaggttatcacgccaagaccactggagaggaagagaagaaagaaaaagtgtctgattaagagaaaaatatgataagagtgaataataatgatgtgggagtgggacttatgttgttttttgttttttgttgatcattgtctcttttattttgtctttctagctgttctccaagtttgtgtttagagttagatcatttgtgtctaaaatctataaaattattttatctatggggaaacacttgtttactcaatggagcttcaatggataaattctcatgaaaagtttttatgtaaagaaaatcagaaattttgatgaaaaaagcatgcaagagttagattaaatatatggtgattcaataatttcacctgaaattagtccgttccgccacaagtcatggcctcatggggatagtaagattactgtatgaacctctcttttttttaatggatttcagttaaccaaattatatgctaaatttaaatgtttttaccatttaaaatatatagatttcagtgaatagagctataatattttatagtatgaaaattcttttaccatttgaaatatatagatttcagtgaatatagctatattcataagtcataacaatagaccggttcaatatcacatttatgaatctatagtatatttgttcataaacgaaagtagtgattacttcttcatagtagtgaactaggcaatggacttttcaattattaaaagaaagagtttcgatagtctaattggtaaattcttggcacataacattatcatattttggggtcaattttatagattttcagtttaaaataaatagaaaccggtttgataatgatttagaactttagattcagtttaatattgtttttagtcatatacagtaacatttgacatttctataagaaaactagattttttcgtttttgttttttccttttaagctcaggtaagtttacatgtggtgcacaaaaatatttgttgtaaagtttaacgtaacagattaattaaatcaatgtagcaaacgaaaacgattgctttgtttggtatcatgtgtcggtagagtgaccaccccaatgcctaaactttttaaaattcggtctgttaattacgggttgcgtgttcatgaaacgtctcaatttatcaagtggcacaacgtcttaaatctttcaaccgagcacgattcatataatttaatgaatttaagcaaaatccgaaattgtgcgttctcaaatgccccatctgttaaattttataaggaaaaagctttcgtctgttatcatacaaggcacaaaacgacatcccttacctaaactgttatacttataaaaacaaattgatttcaaaattaaaatctgctatgctgcatgtacattcttttggtaacgtcttaattcttaaaaaggattagaggagtgacaaaaaaaaaaaaaaaaaaaaaaaggattagaggagtaatggcatgttagtaatttacccgaaaaatatctgcaatctagctttagccgacgtgtctaatggcccacatgaccgacatctatgcttaaagccaatcaaagccgaccattcagctccatgtgtgggcccgttcccacctcttttaatacgtgtcagtaaattattggttcaattcatgccttctacattattctgtttttcttctaattcgtcctaacttctattgtataattagtctttccatttagtactgatcctttggctagataattctgttaatacttaatagttcggttataattcttcccttttaatttgcccctttatttatagtatattttacagatacaacctgaaagtcttaaaagagttggaaacatcacttttgaagtttgaaatttctttcatatgctttttatataatatttttcaacaagtaagtgaagtaaaatgtcaaaacgatttaaaataaaaatcaagaaaaaggttttaaaaaattgttaacttctatttccgggcaaattatgtagtgttttgttgttttttgttacaaaaagtttgaaataataggatggtgacacaacatcaaattcaaattccaaacaactacataacatatatgccaagtccattgaaactctttaaattatacatctgttatccttttaaatctgataaaatgcaatacaataatagattaaaaggatgtacttcaaccacgtaaccatagaccattgattaatccaaaacaaaaccatagaccatagttcgatacagcttctgttgataaaagtacatgactatgcgattatctaatattagtttaactcttcatctatatattaaaaacatatatcgtttaaattaagaaaaaagtggtgatactgatatcatgatattcatctaccgacttcaagaaataagaggggtcattatacaattcaagaaataaatatccatctttttggatcattttaaaaataattaaatctttacagcgttacctccgcgttggcctggacccttctcttgacactataaaaaccccactctctcttatctcatcacaaacattactcattcacaaaaccatcttaaagcaactacacaagtcttgaaattttctcatattttctatttactatataaacttttaatcaaatcaagattaact

SEQ ID NO: 387 - DNA, 3000 bp, Arabidopsis thaliana
atactcttagtggatgcatattttccttattgtactaaagagtaacatgatgtgcaatgaactgaaattatcttacagaaaagtttatgctttccttctatagacaaccaaaccttcattgccatgctctaataaatataggatatctaaaacagagatcaaaatccatttcctatgtcttccaaatgacaatgactcgagcagatttaacaaagagatgatatcgaatgttgcttaattctctaaatcagaattcacgactctgaattaacaaattttaggagtttctattgagattcagatctcccaaaccctaacttccacatgttcaaattcacgtaaccaactccaaattctctaaatcattattcaaccagagctaatatccagcgaaaaacacagctctacggtaacaacaaactacacaaacacaaattggagaaccaaaaatgcatagatctcgaatcataaaaaggcaatgaatcctcacctagaagaagaaaaattcgaggtcgacgagaagaaagagacagaagcccaatcatgcttagatcgaatctgatattccctcagctgctctgctagattcgatcttgttatcatcgctttcctatgcagcgattctccgatttcacaaccgaaacaaatccttctcttctcagtcgactgatatatccggagaagccgtcggagaaacacgagattgaagaacaattcttcgggataggattcgaaatcgatgaatctaacaacgggaaacaactctggagattcaaaaaaaaattcagagacgaaacaatgtttcgattcgtctaaagttcgttagcgtagactcttcctccttccctctgtctcggtgtcaaattcccgggtcgggttttaactttccggttccttacccgattcgattttagaagcccatgttagtgtaatgatgtattacacattgggcccgtcgagatcttaaactaaacaaaatattttgagtttcgtttatggatagtcgccgttacgtgtacgaaaattaatggagttggatcatttgtgtgtttgatctataaaattgtttaatctttggggtacaattatctcattctactcaaaagtagaaattctagagggataattttgtgcgatgttttcacatgaatttagtttgtttatttttttattactatcggatttttttttaatgaaaacatgtaatgtgatctcatatttccaagtgattcttctcttttctagttggttctaaaacttctaattcttttatattcccattttgatgaggtttgtcctaattgaacactacgactaggtggacaaaataatttgttaattaaataaaaattagttcaatatagaaatgaaaacgattgctttgtttggtatgtgtcggtacagtgaccatcctaatgcctaatataaaagattcgatcggtatgttacaagttgcgtgtatatgaaaacgtcacattttattaagtggcacgtcgttgtgatgaatctttcaaccgaacacgattcataatctataagcaaaatccgaaaatggtgccttctcaatgccccctatctgttcaatctttttttttttttttttttttgtatatctgttcaatcttatttaaatgtaatgacaaattaaatgaagtttacgttagtaatataagctgacaaacaacaccacattacatacataaaattaaattcttttaagtatttcaataacgtttctttatcttaaaaattaaatttacttcgagagcttcctacttcgtcaaaaataaaattttactttgctgcatgtttttactttctttttgtaacgtcttaaaaaggtgattaacgtcaacttaattcaccgaaagtctctgcaattgatattttctgccgacgtggcataagaagtccgattggcccacatgaccgacatccacgcttaaaccaatcaaaaccggccattcagttccatctgtgggctcctgaaacgttctcttgacacgtgtttaccatatattggcttaatccatccatagtctttctatttactgacaggtagtatttttcctatcaattatttattttcacgtggcatgatggctatggctagttgaacctgtgaataacttggtcatatctactctctatttatttagatgattcattttcttgaaggacttgcaattttatccccttacttttatttctttgagagataacctaaaattctcaaaatgagttggaaacatccctttgaagttcctctacaggctttctatgtgcataagaatctgcttaacattggaaataatatatgcattcttctccaattctcctagttggatacatatatgaagtctataaattacacatatttcccacaaaaattattgtaagagtttatatttcaacatatagtatgcaaacttaaatcgtgagaatgacacaaccactaattcaaaccactacattatatattctaatccattcaaattcattaattatacattatatatcatatctatataatgttataatatacaatcaaacaataaattagaaggaagtaccatgcaaccaaacttccatacgtctcccgtgaactaaaagtacattactatgcaaatatctaatataagttaactctatatcaatatattaaaaacataaatccttaaattaagaaaaaatatggggtgatttcattgatattcatccaccgaccgaccgacgtaaaagaaaatgggttcactctgcaacttaagaaatagtaaacgtcctttgccataatttaaaaaactaatgaaatctttaacagcgtgtgacctccgcgttggcctggaccctctacttcacacactataaagtcccactcatcacaacaatattcatcacacagctcttgaaaaccatcttaaagcaactcaaagctcaaatcgaaatttctagtttctctttatcattcacgctaagtgttcaatcgaatcaagattaagt

SEQ ID NO: 388 - DNA, 3000 bp, Arabidopsis thaliana
tccctattgcaatattttttcaaatgtacatatatattttatcctgattcgtgaaagcgacgaagcttacaaagtgaaatctactaaatttgatacccccaaatctcttactattttaatcttatatataatctaaagattagtctagattttgctaataatacatactttttaatgttagttactacaacttgtgaaaaccatttgtttttgtctctttcgtttagaatttgtaaagtggggttaatctgcataaatagcattaaattcttaaaccaatgtgttttacgtaagaagtgaccaatatattaccctatgtaaaagctactaaaatccgcatcatacaaaggcgttttacataaagttgtaaaacaaagtttacatctttttaactaaaagtatgtactattgatgtctattccttatccaatggtattacttaacgcattcattgagtaatatttttctttatatgaggaagaatagtgatcatatggtacggttgctaacactttaaatttagatattttcagtctcttaacaaaaacttctatataaatttttgctaatacaacttattaaaatagacacttgagaaatttcattgatatttgaaatatcatttaataccgtaagtagaagaaactagatgaagtggtgggtctttgtatgtgtacatgtcgacgtgaaaatagaagagaaataaatatcagcaaaagggctttggaccggatcaatagccacctaaccaaatctgtgaacggcgttactttcaaataacaaatactaacagaaatatcattgtagataagactttagggtcttcgatcgacatataataaagataaggtttgggaccctttcaagctttttttcggtgtcggcaatgaagttttacgtcgaggtggcattaacaactggacaacggctttttgttttgttttggggtctcttttgtcttgtgaataacaacttttatcacattcgcataaattatatatagatttatgaatttattctcccaaattaatggtttgtctcagtggaaatctactgttttgtccagtgacttgtgttatctatttaattcagttggatgccaaaaataacatatattttcgatctatctattgtggattttacccgatcgacataaaaggaattaaggaccggtattggaccaatattacatgactggtcatgcatggaaacacaccaaacaaaacaataaattttctttgtataaaaaaagaaaaccaataatttatttatcttctgattaaaatatggcgaagagatatacactagtattaaaatttaaaacaatagaatgaggtaaaacataaatacagcatgtcgtggacgtctttcgattgtttttagttctttttttttggttttatatttcaaaacttgttgaaactgcataaaagttttttttttgtgtggatccccgtaatttttattctacacacgtacaagacaattttttcttacgtaaactatacaaacatataaagtgcatgtgactggtgaatgcttataataaaatacaaataaaataatgtgtgattggtggaatatttagagtaaaagaagaatgaatatagaggaatattgatattggaggaaataaaaatatgaattagagtacccaaataactggtattccctacaagcagtcaacaaaactaaggaaaaaaaaaccaaggaaaaaagaagaaaaaattgttttgtttctgttgagtggacaagttatgagattagaattcaaatatccgttcaagttaaagcatggaatcacgaatgctccacatctcaaagaagaaattgaactctttctaatcttagaattcaaagaaacgtagaggagtctgatgagatgtggttggttgctattacctctgattgaatttgatcacatacaaaataacattcgatcttgatgtgtttcgtaggcttttgtgtaaaatcagatgcatatatttgtttcaagggtcgtctccactagagtaaaatgacgcatatcatcaagaatgcttttccaccacattacttacgacacagtcaatattcaacttcgacataaacgaacctatttcgcaaattgtttatgagttattcaaattatgtaaatttaatatactatcatatattttataaagatgtctattaagtaaaaggatgaaaacatatattatttgaaaaaccggatttcagatgaaattactagtttaaatcaaaatatgctttgatttatatagtaatacaagtatttttttgaacttaaattgttatatgattgatatgtcaccataaccgtaaatatttgcgaaataaaggtaatttcttaccatatgtttttccaaatattaagagatacattaaacatgtcatactgatcaaagatctctaagtagtagtaaataaggtttacgagtacttttttgaaacaaacctagaaaatagaagggaatagaagaaacttcaaaagcacaaaaagagaaaaatccaaagaataatttattatacaataaaataaaaacgtataaaaaagggaacaaaatgggtaaagagaggaggaggaggaccctgaagtagggttaaaaaatccatctcctttggtgtctctatcatcaacacctgtcggccttgtcacttaaacacgctcttcactctcttctcacacacctctccttctccttctcccaccatttaatcaattccacaatattcaatttttccagtctcctccgttacacaattccacaaagagattaaacaaacaatagaaaaatatcttcctttctttttctgtgaatacaccaataaagtgacaaaagaaaaagcctgtcttctctcacctgtaattaccagaagacaatataaactgttactttccttcttttgttgtacccctttaaaaacggctactttagagaacttgagaagatttagaaagaaacagagagcttgagagattcctctggctaaacccag

SEQ ID NO: 389 - DNA, 3000 bp, Arabidopsis thaliana
cattttctatttcatattgaattaggagatgttactgtccgtcagattctctagacttttttttttaaagactgatctatgatcagaattccaattttttttttctttaaggaaatacatcagagagaaaaattattacgaaacgattctattacaagtaatgattttaacctttttttttttacaattgacaatcttttcacaacaaaaatccacaagaaacgttagacaatggcataaatttatttaaattaatccgtatatattcgccttctatgagaattgaattctataccactgtaaaattcttaaacgagataagattattttcagcatgtaaaaaatggtttgtggtttcaactcatttgggctattagttttacatttaggcttgcaaccttgtcggtttattttgtgtaggcttttggtagatttgggcttgcaaacccaaattaacttgttggccgacatacatttgtttctattacaaatttaacaacaaacgtcaataaatacacgtgaaggaaatgagaacgaccctcttaagtagtactggaaattgaaaaaaagaaatctagaaatgctaacatgtaagtttttgttaccaaaaatgcaatttgtatgtagccacaatttcatggccgacctgctttttttttcttcttctttctgaaaaccacaaatatgattacacgtggcctgaaaagaacgaacagaaactcggtaatgtgcaaaaaatatcttactcttaatacgtgtaattttggagtgtaataggtctatcgatctataaaacgatactattggagattagattcttctcatctcactttgttcatctaaaaactcctcctttcatttccaaacaaaaacttctttttattctcacatcttaaagatctctctcatggcgatgtctttctcaggagctgttctcactggtatggcttcttctttccacagcggagccaagcagagcagcttcggcgctgtcagagtcggccagaaaactcagttcgtcgtcgtttctcaacgcaagaagtcgttgatctacgccgctaaaggtgacggcaacatcctcgatgacctcaacgaggccacgtaagtctacattctttcttcttttagtatcttgcctcataagtaaggatcttagcaggcaatgtttatggtatactatattagtatagattttagtggaaatatgtttgttttgaacttattttatgatcatatttgactattatcaaagataaagattcatataccgtacattatatatctctatttttctagtttacatgtatagctctaagtttatttgatgattctgttgactacttttggatatgtgttttgaaacctttgataaatactaaaataaattttaatttgaaaatgatatagaaagaaagcttcagatttcgtgacggataaaacaaaagaggcattagcagatggtgagaaagcgaaagactacgttgttgaaaaaaacagtgaaaccgcagatacattgggtaaagaagctgagaaagctgcggcgtatgtggaggagaaaggaaaagaagccgcaaacaaggcggcagagttcgcggagggtaaagcaggagaggctaaggatgccacaaagtagggtcttacctaatcagttaatttcaagcacttaaactcgtagatatattgatccatatcctctctcttcatgtttaatagtacttacaataagatgagtctgttgtaatttctattaatttcacatcacaactgaaataagatatggtatccacagtcaccgtcacattctttaatgttttgcaaaatattcaatagacaaaattaaataatgagtaattataagtaacatcgccgtctagagtctttcaacggtgaaaggatgagagcatatgggagatcgatagccttgtctcttttgtgacgaaccaataaaagaggaactgctttttttcttcgcatgtccactatttactgtttggtatgacatcgaattggtatgatacattgttgtaccaaaaacttcaaaatttggtggcttgtaatcaacattgatccacttagccattccaagcagtgaattacaatccgtggaaggaaaaattatggtccggcaccaacaaattatcacctcatctcccgtcacaaacatatcatctagaagtcggtatgccacaccacataattaaggagcacattactcacatacccaaccaatgtgggacatatctaataagctcattcttggctggtacatgctctatttcatatttatcaaaaaaaaaaatattaggcattgtaaatagcgtttttgctgttgagcaaaatagttatatttgaaagtaacattggtatttataattatagtataacaattaggcattgaagtgtgagtttttgtttttgtttatttaacattggagtattaggttcttagaaatatatctatatactattagtagtttaactacagtttgtacttaattgaaaaaatgttaaaagttgttttaacctagctaattgctaaaaatgactaaatagacatacacaaagacttgtacattttcagcttaacgactaatacatttttcctttatatatatatctctatcgagtctagttattaatgttgaaagttgcaaataaaacagaaatgctaacatgtaaatatcgtagccaaaaatgctaacatgtgtataacggttataaccacaacttgatggccgacctcttttttcttttggtaaccatagaaatggttacacgtaactagtacgaaccaacgaaaactcttcttattcgatagttaaagataatagcaatgcgcaaaaatatctagcactcacacgtgtagttttggattctcattggtcgagagatctataaaacgatactattggaggttagatttttctcatctcactttctccatcttaaaactctttcttgtatttattttcctcccaaaaaacatctttaagagtcctc

SEQ ID NO: 390 - DNA, 3000 bp, Arabidopsis thaliana
tggagcgggaggggtgcttggggcaatcggcgagactatagctgagattgcacagacgacaaagaacatagtgattggtgatgcgcctgtgaggacacatgagcatggaactactgatcctgactatatgagacgggaacatggacaacgttgaaaagtaatgtataatggagaaatgttttggtgtgtttttgctttacttaaaaaggtcttttgtttttttgtatgtaaataacaagaagctctgtttgacagagttttgtggtaaataacaaaaaaagttctgtttctgttaagaagtttgaagaatatattagtggtttcctttgaaatgaaactgtaccaacctttatctactctacaaaactaagttgtagtgatccttgtaatatacgactcatattggtattaaaggactctctcaggcattgtaacaaacaaattgactgctacaaataattatcccaatgtcccacatatagagacccaaactttgttgcagacaaagaagaattgatgataggcaaagcatagagaagcaagaatggtatttggtattcaaaaaggaatgagcttttctgcatatatgagtgtacgaaacgaaattattcaagcaaaactgtatttcatagttaatggtgtaacacacattgtgaattgagatctacattttggtaacattatgtaacttgatctacaattctaaactaagaaacagatacgaattttcaacagactattgaacagaaacgaaactagaagctggaggcttcaaaggcataatcttcaacttcaagggtttaatcccacctttcttaaactgtgggggctttggtgggataatctttagcttcaagggcttcttcgaaacattcgtcggtttctccggtgctagtttaatcttcaacttcaacggcggaagcgagaagccggagaccacttcaccacgcaagaactgatgagacaataaatccgaagcacttcctctctccttagggttccttgaaaaacacgtctctagaaacttccttgcatcacacggtaaactctttggaatctccggcgctttaccttttgatagagcaggcgcaagatcctcaaattcaacctccgaccatggaatcacaccggtatacatctccaatactatgcaccctaacgaccacaaatctagggctttctcagccacgccgctacggactgattctggcgacatgtaaacaggcgttccaacaaacggcaaatcaacatcccagcaatcagaatattctccgacttttctcgaagacccgaaatctgaaatcttcaattcgtaagattgtctacatggaaagacaagtagattatcgggttttagatcgcaatgaacataaccgagtctatgaacagagactaatccttgaagaatcatacgagtaaagtctttaatcatcgtttccggtaactttctatctttgtaactgtccatgaaactgaataaactccctgcagctgcgtactccataaccatcttgtagactcggaatccaccgacatcgaagtcctcttctaaagtataattcccatagcattgcacgatccttcgacatccttcaagtttggatagaatctgaatttctctttcgagagagttgtagtcttcacattcggcggttttcacggcggcgtaaagaggcaaagcgttatcgtcgcgtttgatgtacttgacgagatcgactgatccatacgcaccttttctcaagaacttcacgaactctgtttttggttgcatcttcggaacaacaacaagagttattatgcttcgaatctcttagtatctctcaaggtttttggtaactttgaactgtaattaaaaaccctagaaaaaaacgaatctcttgaaaagttgcagcgacagatagagagagttaaaaaggaaactttggtagctttagggttttttcaagtctgtgacttataaacgtcgagagagtgtaagcacgctccataatctaccgctgttcacaagtaataatagatcttgtccgttgaatttattttagactttttttttaatggacttcattttaaatttttacaaaattaaattattgcattttctatttcatattgaattaggagatgttactgtccgtcagattctctagacttttttttttaaagactgatctatgatcagaattccaattttttttttctttaaggaaatacatcagagagaaaaattattacgaaacgattctattacaagtaatgattttaacctttttttttttacaattgacaatcttttcacaacaaaaatccacaagaaacgttagacaatggcataaatttatttaaattaatccgtatatattcgccttctatgagaattgaattctataccactgtaaaattcttaaacgagataagattattttcagcatgtaaaaaatggtttgtggtttcaactcatttgggctattagttttacatttaggcttgcaaccttgtcggtttattttgtgtaggcttttggtagatttgggcttgcaaacccaaattaacttgttggccgacatacatttgtttctattacaaatttaacaacaaacgtcaataaatacacgtgaaggaaatgagaacgaccctcttaagtagtactggaaattgaaaaaaagaaatctagaaatgctaacatgtaagtttttgttaccaaaaatgcaatttgtatgtagccacaatttcatggccgacctgctttttttttcttcttctttctgaaaaccacaaatatgattacacgtggcctgaaaagaacgaacagaaactcggtaatgtgcaaaaaatatcttactcttaatacgtgtaattttggagtgtaataggtctatcgatctataaaacgatactattggagattagattcttctcatctcactttgttcatctaaaaactcctcctttcatttccaaacaaaaacttctttttattctcacatcttaaagatctctctc

SEQ ID NO: 391 - DNA, 3000 bp, Arabidopsis thaliana
tcgaaatccatatttgatgctcctctgtctgagattttggatgagattgcaagccttcaacacttagcatgtcttagtttgagcaacacacatccgttgatccagtttcctcgttccatggaagatctccacaaccttcagattctagacgcaagctactgtcagaatctgaaacaacttcaaccttgcatcgtcttgttcaagaaactccttgtacttgacatgacgaactgtggatcccttgaatgcttccccaagggtatcggaagtctcgtgaagctcgaagttctgttgggatttaagccagccaggtccaacaatgggtgcaagctcagtgaagtgaaaaatctcacaaaccttcggaaacttggtctttctctgactcgtggcgatcagatagaagaggaggagcttgattctttgataaacctaagcaagctgatgtccatttcgatcaactgctatgatagctacggcgatgatctcataaccaaaatagacgcccttactcctccacaccagctccatgagctttctctacaattctatcctggaaagtcgagtccatcgtggttgagtcctcacaagcttccgatgttgaggtacatgtcaatatgttcaggtaatttggtgaaaatgcaggaaccattctggggaaacgagaatactcactggagaattgaaggtttaatgttaagttcattgtcggacctagacatggactgggaagtgctgcaacagtcaatgccgtacctgaggaccgtgaccgcaaactggtgtccagagctagagtctttcgcgattgaagatgttggctttagaggcggagtgtggatgaaaacaccattgcacagaacctgatgaaacgttttaagcaactagatcaatgtttattaaacagtgacaataagttggtgtattacatataccttgatacaatgtaatgttgctttgaccgtttggatttcatatcgcaattttcttttctaataatcatataacaaacgagcaaaaagggaaaacagagactagcagcaatggcagatctttgatgtcaactgcttgatcagtcagaatcagagtccagattctctgaagacctaacagacctccgtatgctctcttgatattcggcgtcttcatcatcttcctctttcttcttcttgctgagcattcctgttaaagatttgcactctttaagcaaaaattctctaactgggccgttataataaaaaaaaggtgggaccgaggttcttcataccctttttaagaagaacgttctctagtttattcgttgtgaaatcgtccttggttcccagatcctggaacccaactagcctatccatcgcaactcccttgctaagaatggtaaagaaactcgtactttatgagtatacacctaacaacaaaccctgtatgtaagaaggaatagaaagaggcgaaacctgaaaagcacaacgcaaggcaaagtctttattgcaagcttcgtgacaaagaaaggagcattctgcatttatttcagccaagcattagcttcagcaaaggattgttgaaaagccatttcctcttataaaactttcatcaaatggttcactaacctctgcgtccactttaatgaactttgtgtccacatgtctaggtgcaagagttttcagatgcttgtccataatcctacagtaatgcagtaaatatgtttggttatgagctcatatacatatcagaagacgaacaaaaaataagctgatgagagatcttacttgcaccggtaaaattccttatggtagaaatgacatatcactttctcactcctggtgacttcacccaagaaatctccttcactcacctctcgatattcaccatgcccttgtcttttaaacgattctctcttctcaacctctctctgtcaagataaaatcttgaagattttagttcataccaaaagctgcataactatataggccacaatacaatgccaaagttataacctttagtgctgcaatcctatctgcgtgcaatctttctagctctggatcctacagaacatagacaaataagtctaccatagagacctacgcttaacagtcacaacaagcaacattgcacttacatccataagttcatcaagatcaacctcttcattaacaggatttgatccttgcgccttctcatttgcaagaacttcctacaaaacccatataaagaactcatcaaaaccatacaagtaagtcctcacaggtaatctactcagacaaagaaacatcaaaaaaactcataaagtctatcactatttcaaaaacaaattgagaaacattctttaccttttgataatttcttgcagcagccgccattacatttccaaatgctagattcgagagagtcgatttgactgcatctggatccatcttttaacaccaaaaatctgaaacaacagcatgaaaaaagcattaggattcagagataaatgagagctaaagcttcaaaatcatacctttttcaattccttcctgatgcgaagaagaaaaataaaaaaacacagcttgagaaatcgaaatcaaagcttttttcctttctttactaacaatttcaaaaaatcaaaagatgaacaacaaaggtggaagaaacataccaaacgacatcgttttttagtttagtaaaagatatgcattattgggcctttcatatctaaaggcccacaggcccatataagttaaaattacgtcggtcgctaaccactactacaccgacgtcttacttgccatgtgtgtgtgactcttaatcaattacgaattgaatatattacttttacgatgtcggccaacacgtattgagtaaaatatctatgtgatgatgaattcctatccaaaatgaaatttgcatctctataaaagtatcattcaagagatcattaatcttcatcgatcaaagtcttgaatatttcatctatatatacctaagaaagaaaagagttaaagaagtatattttcgattcaaagaagaaaa

SEQ ID NO: 392 - DNA, 3000 bp, Arabidopsis thaliana
ttatttcctaccattgatgatggcaagcaatagaaaatcatgaaagataaaaaaaaaaaggttaaaaatctagtaacaggcaaatactttgaaaaggagttgaaattttgtacataggtttaactcttctattaaaagaaacaaaaaatctctatgttttaaaatgtactactaatttataatttaagaacatttttctgaaaattttgctggttgtttaacgaaaagaaaaatatacaaatagtttttggctgtaatgctacgccactactcacttttccaaggacgtgcatacaaattaccgtaaacggattataggacttgtgttgactaatgacacaattcttttttattaaaagagattagtctccttgaagaaaaagggacacaaattattcgtaacatgttaatcaaaccaaggtcttaagtggctaccaaccgcatacgagtgttgagccgagcagtgctgtgtcgagccgggctggatttggcatttggaatatatgaaatgggccaacaacccaaaagataaaatttcgttacttggacagtaaaaactaaacatgcatgtttattagcccgtaatctgcataatcacaacttacgaagaagacataagaatcaacaggcccatcataaagtgggactaacgatttggtttccactattatttggcccatatattgttaatattgtacacttcaaatattatttagttagaaaaaaaaaaaaaaaaactcttgtaaaactggatggttctagtttagttttaaaaaatggttagatgataacgatattaatatacgataaagtttatataaaatatcttttcataaccaaatttacatgacaactaacattcgggtaagccatgtaaaagacgagatagagattttgaccaaagaagaaaagtagagagaacatgcaaaagccaaaaagaaaacatagccaaatggttgagtggtgtagatggaccgaaccaacagacatgttctcagttcatataccaaccgcctaacattacagcctgtccccatcccctatctttatttttctttttggctcatttagcttcaactttttttaataggtgtgattagaacatactaaaaaaaacatatgttttaacttatattatatgaataaagtgttgtttttaatagtttatatttctattacaagtacaatatataggatattttggttaacaattttaaatttaaaagatattgtgagtacaaatcattaagcttaacacaaatgttcattgcttcttaattcttacaatcggaaaatttggacaaaaaatctagactaatctccaaaacattgtgaaaaattgggggttttttttatcatttaaattgtctatagtggtcaatcattattaaaaaaaattgttttttgttgaaattttaaattataaaaaaaaaacacgtttatacataaaatgcaaaaacttttcttaaaccaaattacagagaaaggctatcaccatccttgtcttgatgccaaccacacttgtaatcccaaaatacatacttaaactatactatactaacatgaattggttatacgattatctatctagttagctacataattcatataattagttttttaaaatatacttatgtaatgatagtaactaaaaaatatactatctcgagaaatccaaccaaaatgctatgatagtatataaaataaaatgaaagaaagaggaaccaagttgtgaaaccatttaccaagaagaagaagaaaaaaacaagatggtcgagtctcgtgatagtatgaagctggggccgaaaccacgaatcaaagaaccatttgacgatgcaagtggtcatcgataaccaatcaatagaaactccaccgcctcaaaatatcatagtgctatttaatttttcatactatcatttattgtaggctataacatatttttgtattgtagatggacggctagtacacgcaagttagtcaataaacttttaacaaatggcatcttgacatgcttaaacacattttataattcgaacctcactttgcctactttacacacgtctacttatagtagatgagcatcaatcattgaaccgttcgtataatacaattttttttttgtaatacgttataattagaaagtaatggaaaataagttgaaacacaaattttcaacggttttactaagatttaattttacaattttcaaaatataaccgaattatttaaatcgtattaaatttataattaattttctaaaaaaaaacacagattaaaaaaatatattaaaactaatcataaatatattaatttttgtaatttatatttttttataactttaaactaataatattcaattatttatcttaaagtttacaaattatcaataataactaataaataatgcataaaaactttttaaaaattaactttttgaaacaaatttttttctaaaaaattaaataataaagaacagaaaaaatattattcaactaaaaatattggataataactctgaaagtttgcatttttcaaataaatcattgattttttttgtttgacataaaacattaatttccccttgtaaatcacacatttaaaatctaactatatttaaacaaaaaaaaaaagtccaattttgactttaattatataaaaaaagcaaagctaattatgggtcaaaagactcaaaggccagaattgacgcagccgtttatgagaagtgagaagacaatttcggagtcacttcctttatttcctctcttccttcactctctcctatataaaccttcctctcctcttcctctcttctcatctcttcaaaccattttcgaaagccttgagagagagaacacagacgataccaactttcttcaatctcgttgccgcagtataattatctcattcctcggatatatctctccttctgcggcggcgacaagaagctacaagaataaaaagtctgttttctctcttttcaagaaaccacttacttcgaaa

SEQ ID NO: 393 - DNA, 3000 bp, Arabidopsis thaliana
tgaggttagccggtgagctttctcttgacgttaaggctgtgaggtacactcgtggaagtttcctctgtcctggaggacaaccattccctcaccgcaacttctctgaagaagtctctgttcttgatggtcactttgctaagcttggtttaagcagtgttgcctacttgatgggcaatgacgatgaaaccaagaaatggcatgtttactctgcttcttctgccaacagcaacaacaagaacaatgtctacacgcttgagatgtgtatgactggtctagacaaagacaaggcatctgtcttctacaagaacgagtcaagctctgctggttctatgactgataactctggcatcagaaagatactgcctcaatcccaaatctgtgactttgagtttgagccctgtggctactcaatgaacagcatcgaaggcgacgcaatctctaccatccatgtaactccagaggatggtttcagctacgctagctttgaagcagtgggatatgatttcacaaccatggacttgagccatcttgtctcaaaggtactaacttgcttcaaaccaaaacaattctctgtagctgtccactcgaccgtggcacagaagagctacgactctggtctctctgtggacctagacgattacggatgcaaagagtcaacaatggagtctctaggagaagagagaggaacagtgatgtatcagaggtttgagaagctaggaaggtattgtggttctccgagatctaccttgaaatgtgagtggagcagcaacagtagctgcaacagcgaggacgagaaggaatagggaatctaaaagctcaagtttttaattttcgttttcttgaataatgtcttatggatatttttcttcttcttcttatttcccttaaaccagtgtttgtgtctggtctatgtgaattcggatgatccaaatgttgaatataatggatcaagtatctattattatgatcattttcatgattttagtgtattaagctaattgctttgcatttgactttaaatctcatgacacctttggtttttcacatagttgaaatctagcttaacctcatagttaacaaggtcataatatttcgccgaggcataataatcgaaagagtcaaagaaagcgagagacgcacgatagaaagaaaaaaactagatatattaaaaaaaattgtttttttttttagatatattaatttgactaaacggctacgctttgtgcccagtcttcgtagagaatcgctacgtttttattctaaccgaaacaagacaagaaacgtgttttcgattgtgtttgtgtatgccgataaactattatatttttgtaatttgatttagttcaagaaattgttgtggcctatcggctatcaacatgctttttgtaagagagaacttgtaatttctgtctatgatttccttcgttttctttttctctctcaaagtcatttatttaaagaacaacattacgtgtgtataattgtataattttttctatttcttactatacttagagaattacatgttataacaaatgatctttgatcaaaagaaaaacaacaacaaatgatcaagaattgctttcttttttttatatgttgcaaaatgaatagacgagccaaacttatactcaaatattgttttatctatttttaagaaatattctttatgcgagagagcaaactccccaaacgatgttaaatggatcacaacacataagtcgatccgaatagttgaagttttctaaaaaggcagtccctataattgtattaaacacactaaatcctccacacagacaaaaagaaatcacgtaaacgagacatttacatgaaacaatcaaaccagtttgattttatccgattttgctaatgagatgagttctgtatattgttataatggatataggagaactaactaaaataaaaaacgcaaagaaaactttatacagtacatattcttacggtcttaccaattatcaacgatgtgttggttatgtacacaaggtaaaatacatcgattcatattatgcataatataaaaaaaataaagaataaaactacattttggtaacttgaattcaaccatgaactgtttggattggcaaacataaactcaaataaaatatctaggtataattgtggttcatacaagaattacttcatactgttgggccaaaggacgtatccttccccgcacctccaaaccatgggcttactactgatccgacatcaaaaccgtgttagttgcaaccaacgaatgataagtcaataagattcaacttgtcaacaaatatacagcttatatgacatgtctggctccaaactgaattttagtagaaagttactaattcataaaattaatttatatacaatttttcaatttttattttataaattaaagaaaaaaacatgaaaaatacgggaggttcggcaaacacaacatttaacttgccaaacgtatcatctaactttcccaccttatacaaggaaccattttttcaataataaagtttttttttttttgtcttcgcaaataagagcacgaaatgtttgccaaacgcatatgcaacaaacccacgttacataattctgtttacagccatagagcaagctatattgttaaagacctaaaaaaaactttactataacatatagaggcttcgagatatttcgaaagactcaacttatatataaataaactcaaaaagaaaacacggaggcgagaggatcatactctcacacagaaagagtcacattattatatcctctaaaaaaccaaactaaaacgacacgtgaagtcttgatcagccgataaatagctaccgacataaggcaaaactgatcgtaccatcaaatgtaatccacgtggttttagattactcgtggcaccacactccctttagcctataaatataaaccattaagcccacatctcttctcatcatcactaaccaaaacacacttcaaaaacgattttacaagaaataaatatctgaaaaa

SEQ ID NO: 394 - DNA, 3000 bp, Arabidopsis thaliana
catcaagagccattgaacactcctgtgtctctgctttcagcaacagaggacgtgactaggacgtttgctcctggtggtgaagatgactatctcggtggtcaacggaaagtcaacgtcgagacgccaaaacgtttggaggaagatccggctgctccaggaggaggatcggattatctcagtggtgtatctaattatcagtccaaagttactgatcccacgcataaaggtaatgactttggccgagactttttttagggtttatgaatctgtaataactcttgtctgttctgtttaaggtggagaagctggagtaccagagattgctgagtctcttggtagaatgaaagtgactgatgagtctcctgatcagaaatcaagacaaggacgcgaagaagactttccgacgagaagccatgagtttgatctgaagaaggaatctgatatcaacaagaattctccggcaagatttggaggggaatcaaaagctgggatggaggaagattttccgacaagaggtgatgtgaaagtagagagtggattgggaagagacttaccgacgggaactcatgatcagttctcaccagaactatctcgtcccaaagagagagatgattctgaggaaaccaaagatgagtcgacacatgagacaaaaccaagcacctacacagagcagttagcttcagctacatcagccataactaacaaagctatagccgcaaagaacgtcgttgcctcaaagctaggttacaccggagagaatggcggcgggcaaagcgagagccctgtaaaagatgaaactccgagatctgttactgcttacgggcagaaagtggcgggaactgttgctgagaagttgactccggtttacgaaaaagtcaaagaaacaggatcaacggtgatgacaaagctacctctctccggaggtggaagtggagtgaaggagacgcaacaaggggaagagaaaggtgtgacggctaaaaattatatatcagagaagctgaaacctggagaagaggacaaagctttatcggaaatgatagctgagaaacttcattttggaggaggaggagagaagaagacaacggctacaaaggaggtggaagtgacggttgagaagataccttccgaccagatagcggaggggaaaggacatggtgaggcggttgcagaggaaggaaaaggtggagaaggaatggtggggaaagttaaaggagcggtcacttcttggctcggtggtaaaccgaagtcgccacggtccgttgaagagtctccacaatcacttggcaccaccgttggtaaaactccctcgtccttgtgttacacgtaatgttaagattttgatgtgtgtattatttttgtaattttactcaaaatgttttggttgctatggtagggactatggggttttcggattccggtggaagtgagttgggaggcagtggcggaggtaagggagttcaagattctgggaactgaagatttggggttttgcttttgaatgtttgtgtttttgtatgatgcctctgtttgtgaactttgatgtattttatctttgtgtgaaaaagagattgggttaataaaatatttgcttttttggataagaaactcttttagcggcccattaataaaggttacaaatgcaaaatcatgttagcgtcagatatttaattattcgaagatgattgtgatagatttaaaattatcctagtcaaaaagaaagagtaggttgagcagaaacagtgacatctgttgtttgtaccatacaaattagtttagattattggttaacatgttaaatggctatgcatgtgacatttagaccttatcggaattaatttgtagaattattaattaagatgttgattagttcaaacaaaaattttatattaaaaaatgtaaacgaatattttgtatgttcagtgaaagtaaaacaaattaaattaacaagaaacttatagaagaaaatttttactatttaagagaaagaaaaaaatctatcatttaatctgagtcctaaaaactgttatacttaacagttaacgcatgatttgatggaggagccatagatgcaattcaatcaaactgaaatttctgcaagaatctcaaacacggagatctcaaagtttgaaagaaaatttatttcttcgactcaaaacaaacttacgaaatttaggtagaacttatatacattatattgtaattttttgtaacaaaatgtttttattattattatagaattttactggttaaattaaaaatgaatagaaaaggtgaattaagaggagagaggaggtaaacattttcttctattttttcatattttcaggataaattattgtaaaagtttacaagatttccatttgactagtgtaaatgaggaatattctctagtaagatcattatttcatctacttcttttatcttctaccagtagaggaataaacaatatttagctcctttgtaaatacaaattaattttcgttcttgacatcattcaattttaattttacgtataaaataaaagatcatacctattagaacgattaaggagaaatacaattcgaatgagaaggatgtgccgtttgttataataaacagccacacgacgtaaacgtaaaatgaccacatgatgggccaatagacatggaccgactactaataatagtaagttacattttaggatggaataaatatcataccgacatcagtttgaaagaaaagggaaaaaaagaaaaaataaataaaagatatactaccgacatgagttccaaaaagcaaaaaaaaagatcaagccgacacagacacgcgtagagagcaaaatgactttgacgtcacaccacgaaaacagacgcttcatacgtgtccctttatctctctcagtctctctataaacttagtgagaccctcctctgttttactcacaaatatgcaaactagaaaacaatcatcaggaataaagggtttgattacttctattggaaagaaaaaaatctttggaaa

SEQ ID NO: 395 - DNA, 3000 bp, Arabidopsis thaliana
tatcactcgctttctcgtgctctcattcgctgcaccaaacacagaacaatgttagatcgtataaaggttgcatctttcgccattcaatgatgtctgtctaaaaactcattatattgtcatactgcatctaagcaagttactcgggtaatcaagggaatgaggcttgtaagacgaatggagaaaacttactatgacggtgacgagtgtcacgagctttcaaatacttctgctcagcaacaacagattccaaagcctctctcaactcagctatcttaacatttaccgggtccaaatgttctaagaaccaaacaacaaaacagaaagaacataacatcacaaaacagctcaagctcaatgcacaaaatacagattgcatcaatgaagatgatcatacataaggggaatggaaacgaaccatctttggctaagtcatgctcattaggaatatgaccaacatgaatataaaaggagacagtttcaggagtagaataaggattgtggaaacaaaatttgtacattccactttttggagccttaaactcaaacttatctccagatgttccctttaaagtctgtacaatgttcccagctggtgacgtcacctacacaaacacaatccaatgaatcaatcaacacattaaccctaaccaaaatccaatccaatccaatcaaagatagcaaatttccacaatcccaaccaaaccctaaattgtcacatccttacaaagatcagatcaggtcaaaattaagcatgagaaacaccaatttcacgataaatcaaacattgggattatcgaaggaaacgtatcaaagttaagaacttttggggtaaaaaggtaaattgaaagatcgctaaccgtgaaatccaaaccaggatgatcggatccccagaagatatcatgatcgacgacgacgaagttaccggaaacagtgtcgccttcgtaaaggacgtactcttggacacattcttcgtcgttcaccgttacagagagagatgagatttgattgattgaattcaatagaattagacctatcaatacaaagacatggatcttcgcttgtcgtctctccatctttttttttagatcttcttcgatcaaaaaaattcagtttgttttctcgagagaattcgccgagtagaggaagaagaagaagacaaagaggattttattgcgacttagattaccaaaccggaaattaaaaccggtttatgacgacacggggagattttattggtcaacggcttttggtcattaaagagagttagagaaaaatattactaattttaatgtaagtaaaatacgatctaaattatgattaaattgataaaattttacttcaaaaagtgtttcagtgatgtttgtttttacaaaaaatttttgatttttgtatatatattggttaatgacttaatgtacgttttggaagttttttttatctacgccattgatatgtgttaaaaagaattgactgttatgtatgcataataatgtcaaggtagtttttatttatttggtcaataatgtcaaagtacttatattctaagaaatcattatttccgggaacaaaatctaaagaatcatatgttttcttctttgtgttaccatgtaaaagtgaatccttccaaatttccttaggttgagaatgacaattcttctttcatatgttatcaaagactaaaatgatcagaatgtcaatttgcagatttggtcaacactacattagaaacgaacatatatgagcgaaagacatgatttggttagggaagctagagttgatgggcctaatgagccctatacggcccgttatgagatacgtatgactgtaagagtaaatagtcttttttttcttaacagtaaataatctttatctccatttaattgtaaagttattgacattttgaaacgaccgtaaatattaccaaaaaactgacggagttaggatcggccacgtagaaagggacaaagagagaacagtcacggactcggccagactaagtatgggcctgtctgaatccaaactcagctaagttccaaaagcataaagagagatgtgtaatgaaatgaacgtattctagaaacgaaagcaatgttatgctttgtttttgagccacatgtttttgggagatggagagaatcttttttacgtttttaacctaacccacttggcacttggccaaaaaagtgagaagaaactgtggcgaatgagtaggccacgccatggactttgttccttgtccttcaaaagttaaatttatgttatgcgtggggacaatctaagcaacgtggttcctttaaatatcgcagcttcctcttttacacttttggagcctacgtgttttgttttggaccggccaaatacacgagtcagtcagtttagaaataatttggatgtccaaaaatcttggagatccaaataaaataattagcatgttttagttcataagaatatgaaatgtagataaactgtccatattaatttttccatagaattggctttttatcgaggtgatgtacttaatgactttgttgattactactcgtataacaataaagaatatgatactatgtgagacttataatgaatttggtgtgtgttaattaatccagttgaaacagtttaataacaaatcagaataaaaattgtagtaagaaaatttgaacgctgatccttcaacctagatagtgaacctttcaaatactatatgattcacgtgtaatgtttttgaccgttggttatttttgtgtgaactatattaacttatcaatatcgaaaggctaaataagtaaataactaaaagaaagttcaggaaacaactcgacctaatgacctatcatttctgatcacccgtcctataaatacatacgtaagatcattcgttactcatatcaagcttctacacacgatctagcttaaagttctgtaacctaagcgataatcacttagctactccaagtttcttcttaatttctctcacactagtagttctaagctttagaa

SEQ ID NO: 396 - DNA, 3000 bp, Arabidopsis thaliana
agagaatgagaatcttcgaaagttcgaattttgaagtggaagatgaagtgtgagtgggcttttatagaccaatgtgattagtttcgtaagaatattgatattagaattaggaccagttcaaaaatcgaacattatccaagaatacgtcgatgttcgaccagcactttgctcatgagtcatgacgatatcaacttggcaaattaatattgtaatcacgtgaaggaccatgcgacatcatcatcatcatttgtggggtaataacataaaactaatgccggcttaagaaaagtgtgttcatttcttaaacttaaatcacatttggaggactcattatagagctcatcacctttgacctgactttatcttgacctgaagctaccaggaatttatatctgaacttttgtttcctttttgacggcgaaataatttgtttagtataagttttgtccattctttacaggtcaaaaacataattaatactaataacgacgatattttaatgtttcctcttgcatgaaaaagcattgaaaatgacggagttgattcactttattggtggctgctttgggctcacattcaacatgtgccaattaagaattctgagggtcgacctacccatcctcattcactcatagcgacaattcaaaacagatctactggggctttaaataagggtaaggccttgttccgaactgggctttagtaagatattataacatttctgttccaaatacagtacatcaaaacttgaatctaacttatatcaacttcaataatcatcaattcatcagttaaaaaaactccttctttcatggtttagtttatcaaagatatgcatttgatttataagaaaacccaaagagtatttgttacctagtcgtccccgggtttcacggggttacaataagagaaacaaaatgggccacataatatttatttatttagtgattctgtcgtttaaaaaaaaattagtttaacacattgtcaaagtttgaactaaggaacttgtaactcaaatactgaaactttaaccattagactacatttttatgcaaattcggccaaaactaaataataatatgattagcggccgcaagcttatgttttgcttgcttggccttgtggccggctaaataacctaagtatataatcaataaattacataaacgaccggataaatcagaacttaattataatgttaaaagtaattaaatgaatgatgaccctcgtcgtctctcctcttaaaacacaataatctcataaatacaatttttatatgaagtcttcacaaactactataaatttcccaaagttgttctctctctttgtccactcgaagactcatggggataagaaggcactcgtgttatgggcttcggggctttttattgttcgccctttcgaggaccttctcacatgtttggacttttgagtctaaatgccttatttcctcacgaatgacgtgaacattttttcgtcctgaactcaaaagtatcaattacacacttcacactactaatggtcaagttttttcgtatttgaaactacaaatgtaagtaatatatgcgataaatttattatcctctgctagtaaaatccattaaaaaaaactaccaatgtgggtgtatgttttctttcagtatatataaagagttttcgcagagagcacatatcgatggtggtacatcaaatctgatcattcatatctaaataattgttgttgagttttctatatgtgtggaacgttagattgcttaagctagaaattgacacaagagtttgatcaccgagttcctgcctcctggcctctaaccggtacgtctcgggtgggaactgtctcccacaacttttcactatcaagcaaaaagtattacaagcactaatagaggtttctcttctccttgttacaaatttagaaattaactcacacacaaaagacaatagaaaaggagactataccgacacgaagactatgcccatatcttcacaattgtgctattatttaccgttctaatctggaaaaaaaaacagcgcacgtaggagaattgggcacgaagacatgaatgggacacataaaggatcaaaagagtcatcatgggtctgccatgatgaaagttaagaaagttccaatacgcgcgaaacaagattgaatgcgacttctctctataccaaaaacgaatctcccaagtcccaagtgaatattgtgagccactaacttgttattaacattttgagacaaaaaaaaaatttgtacgtgtttttgccaaacccacttggccatgaccaatcagaaaaagacaaggaagatgtgtatctatgtgtaatgaggaggccacgccatcagtttacttgcacttttccaactagacgtggcctctcaccgatctcaacctcactttcctctcatttctcaaattttattggctacgtgtttttgtgtttagcgttcaacccaaatatcgatatattcttctttttttttcacatttttaacgatttcgagcaaaataattcgatttatttgtataattttaatatggtagttttacaaataatgaaacgaatgaccaactgatttgttaggtgttacaataaatatggaaaaaatctcataagtttgaaaacatttattctgaggaaactttttcttccccaaaagaaaaaaaaagtttaaagtggaaaaaagaaaaaaaaggaataaaaagtttgaattcagtttttttcttttctttgatagatttctttctacttatttattactctactacacaccacacaaaaacaaaaataaaataagtaatcatagtatcccataaatcagtaaagataaataaaatccagaaaatactgggcctatcattttccttcaccaactctataaatgaagagataatcctacagttacacctcaaaccaactccatctcacttctcaagtcttataatttattcatttctctcttcttcatcgatcttcggcttttagaaaacctaatcagaa

SEQ ID NO: 397 - DNA, 3000 bp, Arabidopsis thaliana
ggtggtgaacgtagatctagaggaggagaaggttgttacaattgtggtgatactggtcacttcgctagggattgtacttcagctggaaacggtgaccaacgtggagccaccaaaggtggaaacgatggttgctacacttgcggtgatgttggtcacgtggctagggattgtactcagaaatcagttggaaacggagaccaacgtggagcggtcaaaggtggaaacgatggttgctacacttgtggtgatgttggtcactttgctagggattgtactcagaaggttgctgccggaaacgtcagaagcggtggtggtggtagtggaacttgttattcatgcggtggagttggtcacattgcaagagattgtgcgactaagagacagccttctcgtgggtgttaccagtgtggtggttctggtcacttggctcgtgattgtgaccagagaggaagcggtggaggaggtaatgataatgcgtgctacaagtgtggtaaggaaggtcactttgcaagggaatgttcttctgtagcttaatcgatttcctaatcaacaaaacaaaaaaacaagaatgaaattgaatcgagttatatagtttggtatatattactcttcgttttcatttatctttttttttgttgttgatgggaatgaaattgcctggtccttttggtgtgtttttgagcttttattattatacagagtgatccctttttgttataactattacaagtttttagctttatttgatatggatgctctctccttttcttctatctgtttctggaaattttgacctcatcatattacttatgtcatccaaagtttgagttttgtcctttttattaaagtgctgctagtttcagttcattgcttttgtacttggatgttttgactattagcagcacaggtatgacgtctcaagttcaatagtactttttaaccctttgacacaagatgaatccaatccactggttcttttgttgttggtaattgttatagactttttagctttatctgatatgagtgacatcccaattatcaattgtgacttaattagtaacctgtgaattgatggatatgattttgcagtttcatccttctttaccaataaaggactggatacaaatcttgtggacaaagttcaagtgatgacctcagtcttacctgattaatccctgctttgtacagtcatttagggaatgtcacagtcgttttaaagggttaaaagtttgaacctaattcactattaactaaatccaagactgatgacgaatcttcctgatagaagaaactggaaaccaaagtttggtgttcaccttttcatgtccaaacaaagccacaaaatcatatgatcattggttagaagattatagtaataaaccacatataaaaacctgattaggttaaacatcatccacatctccttgtttatatcatcacttggatccaatcaacgaaaaccttgctaatcacctcagatcgcattaatcactaatatttttcatggtattaagttccattgtcatatagatgtctcttgaaatggtagcttaatgagcaattttaaggttatggatcaatttcttttgatatttggtcagtttttttttattccaagtgcaatcgaacctgcaacttctactagttttacatccaaaaactcggatcttcaaccacacatggatttaaaggttatacttcattttatagaaatatgcactaaacataaacgcaactatatagccaaatctctaatcagtcataccaattttgcttggatgtttggaaagaagatcaaattcaataaatttgcatagtagaaacatacatgagacctaccccacttgtagtatttgtttttcctatttgaacataagaaccggtcacatgtcttagtcaaaacataaataacttgtaacaatggaagaagcatgaaccaacaaagttaatatctctacatcacacaactaaaccttggaatgtcgttgacccaacaccctttctttataaaacaatctttacggaaattctcatccaacgttagccactgtatctctttccaataataactcaaaaaaaaaaaaaaaaaaaaattgtattcctctcctgaacttctgtattgtatgttcctgcttgaattctaaatagagagagatagatgtttgagagtctcacgaaatatcaaacatcatcatatttagttttgtcatcttgtacttattgtaataattaattaacagtgacacaacacaacttgggtggatagtagctatagatactttgtaagaccgtgtcccttggaagaaagaagagggcagaatctaaggatggcatcacacaatacgttttctttgtcagccttttttgttgttcaccttatttccttcaatacatttccattttatggtgattagtctgcgttagtgatcgataaaccactaaccaattttttctcgctctgctcttttacttaaagaaaaagaaaactacaaacgaagtaatggatcgtctaatatattatttaagccaaaggaggagacaagttctattttagatcaccgacatcaagactgatcaatatccatatgcaacccatattgtcatattgcacgaatcatacaaaataaacaattaagaacatgatataataatatttctatgattcaaaagaaatgtttctacatataaatgctcattaaaaataataataacgtgaacatgaacgacacattggccgactaacttagacaaaggcggcatgggctcacgtgaagccgacctttctaaaaaatctccaagccctttaaaagattcaaccatcccctaaacctctctctctcactccaatttctttcattaccatataaatacaacgccttcacatttgcactctttatacatttctctcgagagcagaaacagagtcaccggtaaactcatctccggcgacataaaaacacaaaagttcatatatttagattctggtgactctctgctcta

SEQ ID NO: 398 - DNA, 3000 bp, Arabidopsis thaliana
caagtaatgaagcaaaaagagatttgaaccataatacatctaatcagtttaagaaggagcctttttgattattaaaaaataaaaagattgttttcatcaaatatctaaatagaaaatgatataatttactaaaaatatgttttacataaagatggatgtcatttaaaaataataggcttgggaggagtctaaaacggttgttttcacttggctatccctagggcccgttacgtatggtccgattgtttcgtctaatttgcaacatgaaattggtgcacattatttcttcatatggagtttgtaacaaagcaaaacataatattcacgttaacaaaaaaaaaaaagattaaccacgattttagtataaaactttagaccaaaaaatataacatttattattggtcttatctggcaaaaggatcttatgtcttttattttgtgatcaaaatcaatcaattcttcttcttgatcattcttatctcagctttggttgctccaatgttaggaataatgtgaaaacatattgttgaatgacgacgaagacaataaacatctcctacttgtatgtgaattttgagttttgggcattgagctggtcttatttcgtattgtttgaatcttgcatatgaacaacgcgtaacaaattggaagagctaatggtcgaggtccttgtgaattgtgagtatagtggagatgtacgtaaaatctgagaaggatatgcagaaaatgaagaagggagcctcatgctcttattttcgataattcgatttataatcactgtaaaaaataaaaataaaaatgtataacgagaaatctggagccaataatcacgtgttagatgtgacacacacgagacatattttgttataaccctggactggacagtgaacggtgcttactgcttgcttagcaacgactcttcggtcgataatgacaccatctttacgtgcgatcgtattattggtcgtttaactatcgacggggaaaattaacaaaacgaattaattatggacgcgtccaactattggattttcttggattctcatccaaaagagctttcactcttttaggccgtgaaatctaacggtcgaacgtcagacaaactttgcgactcactctcaccatcaaagtcacatcacagggcagttggatcgctgttcttgttctgtatttcgaagaagtttcgtttgccacttctttttatgtcggtaatatattaactaaaattggaatttcgtattgctcttcttgtgctagatgagatgtgaatcaaatgaagcatggggatattattattattgtgagaacgtcaaaaataccttttgaaatttcttaccttctaatttgttaaagacggaatgtcattgtctgtaattttctttttataagtatataataatttagtacatcgatctttcaaatggtaatatttctaatttatatattcaatccaaatgaaaataaacaatcaaatcaaacaaacaaagtttacgtttatataacactgttaactatatatgtgtttgctctttcgagtcaagcaaccattataacatatccctttttaagaaatcatcaatgagatattaaagaaaaacctaagagcttttttagatatatcaaaagggtaagatccgaaaatgtaaggataatatctgtggtttgagcagtagtagtattttcatcattgctgtaagcgaaattagtagtggtcgacaaagaaaaagattaaatagtaaagagtggatggccacttgggacgagtcggagtcaaatatacgacgacagttggagaaacttgacatctaccttggcccgttcttacttcttaactcttaaaaataccttagtgggtttctgccgtcagggataatttttattatgaaatccttcattttaatccggtgacataaataagatactagatcatttgaaagataaataatgtatcataataataaaaatagtgtttttgcgtttttggcgatactcatactatggattaatttgttttgtggtaggatattatttaatatgagtaaaatacttaacaatttaattattttaagaaaagaatttaatgtcattttcttgtaacatcttatcaactagagattatacactataaacttttgtatcaagccgtttttaaaattatgtgagattttactttttctaaaaacaattcaatgatatgatttctcttgtttttacttgattgtccttatataaaccaaccaaaaaaatactatactttaatacttgttaagtaatattaaatatccatcttagatattttacaactctttttaggtaaagatattttacaaccttttcttttctttgttttgcaaaaggtttttaacaacgctttacatccaatgcagtttgtaatctataaaagaacatataaacttatactccgtaaagtaattagttatgaattcgctcaaaacattattctcgtttgtctaaaattaacataaaacccaatataccggtaaaagtaaacatacatgcaaggctaaaagacgtgggcataacgtgtgattgggaaaccatcggaaacaaaaataaggaattataacgaatggccatactaggttgactaataagagaattattatttgacgtatataagataataagacaattatgggataaaattaagagacataagtgtggacacgtgaagcttagagtacgtgtcaatattcaataagacataaacaacaacaaaaaaaagggtttattctctactcttgttttgtttatacaagaggatgcatctactgccccaaaacaatcctgaccgttcatgtctctattcttagatccaacggtatgtatcagctatctcattgtcccctctcatagctttctatataaaccgaaagaaagaataatagagtcagagctaagacttaagagcgtcacaacaatatcacactcagataaatatcaagagatagagagagtaacagtgatatagtcgagaaa

SEQ ID NO: 399 - DNA, 3000 bp, Arabidopsis thaliana
tggtccggaattcgttttcttcattgaaacagagccagcagaagctaaagagccagacatacggccagtggccataggagcacctggacctgattgtgcagttcctgcaaatgagccagaccttgaaggagcacctggtatgggaccagacttcctggacttagtcccatctgctggaatatcaaacatcttccccaattctcctgatctcttgatatcaccaccagtgtaaggcatggctactgcactcatagttggagccctttctttgggttgctcaggccgaccagacacaaatagcccattgctgagctgatgagatgggtatctcgaacccattttggtgatttaaagaaaaaccagagcaagttactctgagcagccgggttcaaaacgtaagaagttcaaatcctagagaaacaggagaggaagaagtgagaaatgagccaaatgcatactgcttcacatgtatatagacataacaagattaaaataatgaagaaaaagtcctcgtcagattaaagattgtgacaggtgaaacaatgggcaataccacaaatcagaaacagcatcaaagacctatgccgacaactacaaggctagcagccagaagtgagtaactcagccatttgtattactaaagaggaccactaactataggctcagatctctaagtttctaccagcgatttttgcggtaaccaggttttgtctagttcaattctaaataacccaatttatagaaaaatctgaatgaacagaaaaaaaactaaagataaattcaacgcagcatcacaatcacatcaaagaaaggagttctctcagtttccatttcaagtaaaacaaccaaaatcggaaatctagatcaccatttttaacaaagccccaaaattggaaccaggtggaaatgaaattggaaaaacacgatcaagcagaggaaaatcgaatctgggaaaatgacaagaggtggattggaacctgagtaggagaagagagtgagtttcggagaaaatgcagctaacgatatcaggaaaagtgattggtattgtgggagtgacagtagaagatgaagaggaagcaatactggggaagccaagatcccatcaccgttgagctctctctctctctctctcgtctccgtcgtgtggatctcgatctcgatctctctttgagccgcaacaactgatgagttgtctcagtctctctctctttctctctcctcttccttttcctctctctctttctctctctaaaagggctaagttttttaaaaaaatgtctaccaaactgatacaaagaggaagaagaagaaacactctgtacttttttttttaacaagagaagaaatgaaaacaaagatgtgaatttaagaaaaaaaataatgtgtcgacattacaaaactgtatttaatcatcatttgaaaacatttaatcatttgataaactatgtaacattacccccttaatcttctttccacctaacctttgtatcatttgttggtctttctattttataacattccttaaattattgaattaaaactatctaaattctgttaattactcacttgtaatccattttgttcactggaaatgtaaattttactgtcttattttgcaaaacactcttgaatttttttttattttttttctggtcaataagacacaaacatgttggattataaactattgtgatcataactctgttcggtaatgttttcaatatcaaatttgatagttggtgattggatttgtcaacatctctttttttttttgtttaatcctttgctaagttaagtcggccacatatatattgggtacgattttcataggtctttcctcacgccagaagtgttgttttattttgttgattgagttattaattattggaagcttttctttcaagcaaagtaaaatgcgtaataatgattagtcacatccaatggttagtcagtctattacaccgttaatcaagctctggtcatataatttttttatttttggaactaacacttattagtttaggtttccatcacctatttaattcgtaattcttatacatgcatataatagagatacatatatacaaatttatgatcatttttgcacaacatgtgatctcattcattagtatgcattatgcgaaaacctcgacgcgcaaaagacacgtaatagctaataatgttactcatttataatgattgaagcaagacgaaaacaacaacatatatatcaaattgtaaactagatatttcttaaaagtgaaaaaaaacaaagaaatataaaggacaattttgagtcagtctcttaatattaaaacatatatacataaataagcacaaacgtggttacctgtcttcatgcaatgtggactttagtttatctaatcaaaatcaaaataaaaggtgtaatagttctcgtcatttttcaaattttaaaaatcagaaccaagtgatttttgtttgagtattgatccattgtttaaacaatttaacacagtatatacgtctcttgagatgttgacatgatgataaaatacgagatcgtctcttggttttcgaattttgaactttaatagtttttttttttagggaaactttaatagttgtttatcataagattagtcacctaatggttacgttgcagtaccgaaccaattttttacccttttttctaaatgtggtcgtggcataatttccaaaagagatccaaaacccggtttgctcaactgataagccggtcggttctggtttgaaaaacaagaaataatctgaaagtgtgaaacagcaacgtgtctcggtgtttcatgagccacctgccacctcattcacgtcggtcattttgtcgtttcacggttcacgctctagacacgtgctctgtccccaccatgactttcgctgccgactcgcttcgctttgcaaactcaaacatgtgtgtatatgtaagtttcatcctaataagcatctcttaccacattaatttaaaacaaagaaaacatcaaa

SEQ ID NO: 400 - DNA, 3000 bp, Arabidopsis thaliana
aaaaacatccatattaagttctgttttcctcatgaaaaacagataagagaaacaccacataagaggcatcacaaattcgtcgagttttatgatgtccgcggtgctgaagcagcattgaaggcattaaacaggtgtgagattgcaggaaaacgtataaaggttgaacctagtcgccctggaggagctcgtcgaaggtttctttctttcttagatctgctacatgaataatgaatgccattacatttcttacatctgaccatttatttgatctgctagcctgatgttgcaacttaaccaagatcttgagaacgatgatttgcactacctaccgatgattggttcacccatggcaaactctcccccaagtgagtctatttcttgatgctcttcttcaaacaaatttgtttataatatcctcaaagactgaaactgtttgatttagtgcaaggtaactggccgctgaacagtcccgtggaaggtagtccgcttcaaagtgtacttagcaggtcacctgtttttggcttaagtcctacaaggaacggccacttgtctggtttggcttctgctctaaattcacaaggaccaagctcgaagcttgcacccattggcaggggtcaaattggtagcaacggcttccaacagtcatcacatttattccaagagcctaagatggataataagtacacaggaaatctctctccttcaggtcctttgatctcaaatggaggtggaattgagacgttgtcgggttcagagtttctctggggaagtcctaacgcacgctctgaaccttcaagttcctcggtttggtcaacatcatccactgggaatccactcttctcaactcgagtagaccgatctgttccatttccacatcagcatcaaaatcaaagtcgtagccatcatcacttccatgttgggtctgcaccatctggtgttcctctagaaaagcattttggattcgtcccagagtcttcaaaggacgctttgttcatgaacactgttggtcttcaaggaatgagtggaatgggtctcaacggtggaagtttctcttccaaaatggcaaataatgggatcattaactctggaagcatggccgaaaacggtttttcaagttacagaatgatgtcttcaccgagattcagccccatgttcttaagcagcggtctaaacccagggcggttcgcctctggctttgacagtttgtatgaaaatggtaggcctcgtagagttgagaacaattcgaaccaggttgagagcaggaaacagtttcaacttgatttggagaaaattcttaatggagaggattctcggactaccttgatgattaaaaacattccaaacaagtaagcttttcctttctttatctttacttctcttgaaatatacttggaatatgatgcagccagattactgaatgagtttcttttatatcaacagatacacctcgaagatgttgttagctgcaatcgatgaaaagaaccaaggaacttacaactttctctatttgcccattgatttcaaggtaaaaattgattagagattcaaagttccaaaatcactaactgatacaacgagcggttaataaatctttggttttgcagaacaaatgcaatgtgggctatgcattcatcaacatgctcaatccagaactcatcattccattttatgaggtttccttccctctccgctttctttcttatacttttagctaagatcactcgaaaggtgaactaacaaacatccaatatttgcaggcttttaatgggaagaagtgggagaagttcaacagtgagaaagtagcttcattggcatatgctcggatacaaggaaaatctgcccttatagcccattttcagaactcaagcttgatgaatgaagatatgcgttgtcgtccaattatcttcgacactcccaacaatccagagtctgttgaacaggtaaagttactctttggtctgaaagttaatgctaaaccttatggaagttaatactgcataatatagttagcgatgatctttagacttattactcggattaagtagctatggtattcttgttcttcataggttgttgatgaggaatctaagaatatggacctcctcgactctcagctcagtgatgatgatggcagagagagaagctgacacaggagttgagagacgactcaatgttgtgataatggctgttttttttctttctaagtactaatttttaaccgtacatattggtgaaaggcagagttaactgatgcatgcaggaccctgcggaagtgtgttttcgaattgcaggttttaaatgctgcatgcagaagctgtgcgagtatttactctgttttttttttttttttttctttcttcatgttttttggttccatggagtatatgtaaaaaaaaaaaccatgaatactcggttttatgtgggtattatgttgtaactctcacaactcttgttaaagcttttggcaatttgtacagtaagaaaaaaagaattgtctctcaagtcttttttgtcttattttttggacagaagtctgtcttgcaaaaaaaaaaaaaaaacagaggcacaacatttgaaaagatgaagatatacatctgaaactgaaattagttatgtcggtaccaatgaaattttgcgttaagctttacaattattttatgataagacttgcaatatatataaataaaaaaactagtgaaattatctatgatcgacatgaaattttgtcatgttccaatgaattagatatggtaaagctgacgtggtatcctaagtggggtggatttgaattggagttgattccaacggtggagattcaaagattctttgattgatagtgagcgactctcgttttccaatcacgtgtaactcggctccactctaaagcacgaaatcaacacgtccacgtaacgatcatatattcatgcagtgatatagtcgtttaacagaaagatcactccgtcaatctttccaccactgtgactaaatctaaacaatttc

SEQ ID NO: 401 - DNA, 3000 bp, Arabidopsis thaliana
gttctatctgaaggtaaatcaagcttgatgatgataactaggcaaaaacacgcttgaagcatcatcatatgatgattaataatacagtttgataatagctatctgttgttaacttcagagtctgtcttcctatactaactggtcacaatctgactttcagaaatcatggatcagctcgtgacagaaggtgttctttcgaaaacggggaaggacatgtacattaaaaagagagacaaggtgattcttttatcctgactcctactttggtttcatttacttatgactttcgcctttgcttttaaattttattttctacctacttaccccaaaatttcagacaccagagagcgaattcacctttgtgaaagaggaagccgatggtcaaatttctccagggaaatctgttgctcctgaagactacttgtacatgaaagtgagggagactctgacttcttactctatgtttaacacactagctcaaaggatagatgaatagagatggtccggagatccatgattgacacttggctttttttgttaggctctttaccattctcttccgatgaaatatgtgacaattacaaagcttcacaacatgctggatggtgaagccaatcagactgcagttcgtaaattaatggacaggatgacccaagagggctacgtggaagcttcgagcaaccgcaggctaggtttgctacctcaattcagacccttctctgttaagttatgttggttgttgtgtcattttttcctcactgatgcaatgtttataaacagggaagcgtgtgattcattctagtctaactgagaagaagctaaatgaagtcagaaaggttcttgccaccgatgatatggtaataatacttgaaaaccagaatacctctttggaacagctttctaatgtgaatggtttcacaggatgtggatgttaccgaaactattaacaagacaaacggcccagatgccaaagtaaccgcaggtacactccttatttgcactttgcaacccaagttttaagctgttttaatcgatctgacatatttgaaacaaatagatgtatctacctgtggaggtatccactccataggttcagacttcacacgcacgaaaggaagatctggtgggatgcagcagaacggctctgttctaagtgaacagactatctctaaagctgggaacactcccattagcaacaaggcacaggtagtatgaaatcaccactgagagtgatagacatatcttactgtgtatatgactcttttaagtgtttgctaatttggttattgttgctcactcagcctgcggcttcgagggagagctttgcggtacatggtggagctgttaaggaagccgagacagtcaactgtagccaagcctcacaggacagacgtggcaggaaaaccagcatggtatcttacactaaaccatataaactctctctacgtttttcaactttttagttatttgctgaaagaaactgacatggttcttgtgattgttattcctacaggtgagggagcctattctgcagtactccaagcgtcagaaatctcaagctaattgaagacaccacctctatcagacaccataaccaccttcttcagtggtgatgatattaacctgaaacactcgctttttattgctttatttctcctctgcattcagactattttcatactccatgcttgttattatctctcttaaagtatcatatcttatcgcacttttgggaagataatttattgcatatcaaactttaacacttattagttattactgtgagtattattcactaatgctctacatgcttttatggaacaagtatgaagtataggactatcttcgttttaaattcccctgtcgatcactttaatccaaaaactttaactttagatactaacacgtgttgaaacgtgtactacgccattccacgcgtcaggaaatcgagcaccgccgaattcatctcgccggagcatcaccgccttcgatcagtcaccgccgatccgtctagtagtgatggatagccttctccttgttgtcgatctcgaatccaaatccaataaacgtcgaagatctgccggatagaacaaagaagctgcttcaaaaatctccaagaaacaccagcgccagggaagcttcatctataacgacacccatattggtgaagtcgattctttgctcttcctgagcaaaaggaattgatgaagatattattccttgaacacaacggtgaaaactaagaggatttgtgaagaaaacggcgacatcgacagaaaacatggatggagatctaaaccagacagagccggttacaaaagctgacctaaagtcagattattcaattcgccgtagcgaaatttacagattccgattaacggaaaacaaaagaaaaaccaaatactaatctccgatggagatcggagaacggaggttctctctctctgaagagtacgagaggggtaaactgggccgcttatttcgcatgtacgttattgggcttctctttgtaattgccctaatggactgttttaatgaaagtatttggccgacaaaaaataatccaaaaactttaacgcttatacgttcactactcaatggaaagtatacacgtgttcgtacaagaatcccctagaatattttcgtcattccgagcccacagcttaaaagtccagaaacatccacacacgacacgcctttctagaaacgattctttttttaataccccacacaccctcagatctattatcaaccgttggattacgtggacaagtccaatgccactcgtatttttaaccattcctcacactcctcaacgtgatgtgaagatactttgctgtttcataacgtcataaagaacagtgacaggcgaaatttctcaagaaagcaaatcggaagaactcacaaaaaaaactaaggtaagagattattatcatcacttttgttcttccttcactcaaaactacgatcaaaatcgtgatttcatcgtctttggtgtag

SEQ ID NO: 402 - DNA, 3000 bp, Arabidopsis thaliana
aatcagagattcaaatcgagaagaaagcgttgaaatcggaaacctgctaaagtcttgaaacgaatcaaccaaacgaaacgaatcaacctataagttttgactattttacaaaatgggctaccaataaaatctaacttaaatacatgtattactaaatttaaatgtttttttagatgtttcctaattaaatggtagttaaaattctaaaacacaaggattgtgagaaaatctcatgaaatcattttttgagtttagaaaaagttgaaatgacatcccttctctaaacctttagattcctttttttttttttgtttgacaaaaccttcggattcatttaaattgatattgttgatcggcaaaattggtgatcacttctgccatcacaagattcacaatcaatggatttgacatctggtctttatattacaaatatagaaattaaatgaaacactaggaagaaattactgttaccaaactgtacgtgataaaggaagagatcacaagttaatttcttagtaatgtcttggtattcatgacttttccccaaagtgaaaaggtttgaataaacgtaaagagacaacaataaattaacgtaaatgcttttggttttctccgacaaactttacctatcttctattggtcgtcatttttaccaattggcatcatttgacatgtctcttgtctcctcagtcctcacccgtccccaacttccatcgtggttcgagatgaccggattatgattttggtttcagtaatagaagacaatgccaattcggtggatttgctttatgacattttttggtcccaaactaagtgattttgtgaaggttatacggatatcatcatgcgattaattagcctttaatttgttcgtgtacgtatatcatcatgcgatacatcattttcagaatgatcatacgtatatgcaaccatttgacgtatcttaatttatatagctagcaactcttttttcgtcaaataattgtttagacgtaattttaatttaatgtttatgaccgacatgaaacatacagcttagtataaccttcaataaaataaaataaaaaaagcttagccgggcaatggaaataaggggcatgctcttttcccatgcaaatgtatattaatatagtgtatctattacacgcgcctatataaatgtattcatgtcccaaagcttgtgtatgctatgtaactttgggttttgagaaaattgtgatgatatggattcgtcaagaaaatataaacgatgtggttttggagctgcactgttcgttgctaacatcttcttctctctgctctctctacactgcatatctggtatatatacatatccaaatccctgaaatattgcccctttattaatccctttctgattatatgtatatactaatgtacatgcatgtaggggcacatggtcatcaacaaagaatgaaagaatcggttatgggttcagagcctcccgtgtgtgcgacaaaatgccggaactgcaagccttgccttccttatctatttgacattcgtggtgctcatgatgatgatgatgatagtgaaccatactatccggtaaagtggatatgtagatgtagagatagagtatttgaaccttaagaatagtatctatatatacattatttatctagtgtcttgcttctcatggatgttcatgatctgacccatgaatgatggcatcatgatggtggttcattggatattgtcgggaattatacaatctttcgatatgtaatcaggtaaacatttactcgtggcttggcatgtgttcattgatagtcatggtgtattggtgtgtattaagaaaggaaaaaaagttgatgatgtgtttgtcatctcatctatatgtatcatgcatgtcgaatggcacacggatccacatgcgtactaattgtgggcctgaattgttatgggcctacaaagagcagccggaatagaaaaataaggatatgggcctactaagcataaagttccaaattccagtaacgaagaccttttcgcaagtcatcaaagcacaatcccacaccgtacgttttggtttacctgtctgtcagataacgaccgtctcaatatcggatcttaattacatttatgaataactcgactgcgcctccgcaaaataagaagaaattgaatatcgaacatttcaacctcaggcatcacatccaagtgattccttatgttgatgtaaaaatgggatatataggaccaatcagattcatataataatattcataaatcagattcgtaatgcagtatttatcagctccataaatgatcctagagaatcttatgtaaagtggatcatgcacgtatctttatcttctcaaaccttcgaaagaaaccctcaaaacgttattatctaccgaatacatttaatccatatagcgtgacaaaagaacagagcccgtagttgataaaaagcatgagagtgatgatgaatgtgaagcactgagagagatctcaccgcttgccgtataacgtctccgtctccgtctttgtcggcattcgtcagctgaactcttaaacgtgtcgactgttgtctcgatccaagataacactgtagctgacagttacatttagagtttgtctccatctcatgcgcaacgcagcaccgtcaattttctgtgaggatactaaactactatgtaatgatgtcgacaaaagagtgaaaggtgggtcccgcatttgcccatgtggttatggtcaacgtgtcaaagtactagcggctgtgttttaatccgatctttttctatcaatccatggtcccgtagaataatttcactattttttcacttggctggtgtcaacttagagaccaataatatatacacttatcttttacagtctaaatttaattatgcggcttaccattatataagactctggtagactactctcattatatacattataaagatactgatgagtggttcttgtttaatggagttttaaatttaaaaatatttggtaaccgagtggatcatc

SEQ ID NO: 403 - DNA, 3000 bp, Arabidopsis thaliana
aaagtgtaaaacagattgtccactttcgtgtcaataacacaattatttgaaaacaccaatcaaacttgtcatggttttgcaagtccaaaagaccaaaaggccctattctttgtctacataaagctcacatgcatctctctctctctctctctcgttcataatgagatattaagatcaacaaaaggaaagaatggcaaaagctatggagctttgggtgggagagatgaagaagatgagtgagaagataaacactagaaatccattgatgcaaaggaagaattcaacatctgttgtgtccaaacaacaacaaggatcagaagaagaaagaggacttattaaccaaaagattagagagaaaaatgaagctgtaactatgtctgagctcactgtttgtcttctcatggaccgttttgttccttggtgatctttccatacccaactacttctagatctcttctttggtgatgtgtatatatatatctagaaactacatgtagtatgtctatatatcagattttgtttgtgcagaccatgtttttaagtttccttgtaaacctgtgaaagtaatgtgtttgagaaacatatttttattactttaatcaatagtgttcaattattattaaccgggatttatatgaagatggaactttctattcactctgtaattaggaacattcgcatcattcagtaagaaataaaacaagaaatgattataatttttctaataacgtaggaattctgagggaacccaaaactaaaatttgattgaaagattttgaagtggccaatcatgaatgagattgctggaagatatcatcaatattcaatacagataacgatttttttttttttttattgataccaaatgagctttcggcttttggcccagacggaaacaacggttacaaaaggtttgggctttgggctttgggcttttgatccacatgacgatcatatagttctttccttcaacacaaaacacttgaagtgtatcttatcaactaaactctattccagcaaaattatttcaaaattagatatatgggagaatttttacaggccattctagattttcattaacgctgtgatttatccgttaataagtacgattaagagtaaaacgacgtcgtttgcaattgaaacaaaaatccccaattcagaaataagaaaccctagatcctcaaatctcttcttcttttcttcttcgaattcactcctgtattttgaaatcaaagtgaattgcaaggcacaaagttcatgctttaaagcactgcaaatggcgaagtcatgatttatatggcatttttcctgtttttgtttcaattgcaaacgacgtcgttttgctcttaaacggtctcattaacggataaatcacatcttctaattgctctgtttattcagttgatgttgtgactaatttggctctgtcaacgaaagttagtgattttatctgaagtcaacacgtaattgatgattttaatcacaaagtacaaagtttatgtttaaagcaccacaaattgcgaagtcgtgatttaaatgacatttttcccgttctggttaaactaagtttctattatttaatatggatattgtggagcgtagtgtcagcactcagcagcttatttaacgtgatactctttaaccgagtaacaactagtgaggtcatattcaggaccgatccaacaatattgagggttttactccaagtaaaattttagttttatttttaattatcataaacgacataaatataatatggaaagatcacaaatactgattaaaaactaaaatcatcaaaacgaaaaagaaaaaagaaaaaattgggttcaactctcatgagttattaaacattttaggttttaggcttaaatctttaaaaaaaatcagaactgaaaaacgaaaaattctaattttattttggactctgattcatagcttatgtcgcttatgtagttatgctagggatgaatctgtatttcgttaccgtaatgagagttcgatactctcttacttgttacgattctggagcatgttacatttttttctttccgtcaacaacaactttaatatggtaaaacaaaatttatttttatttggctggtcctactcaagacaaatcttctgccgacatcacataatcatattaaaaaccataacttctgccactctgtttttttttttttttgtaaccattaactgattggattttgatccatctcatctgattttttagctcaacaatttacttgcacattttctatttggttttatttatacttagttacatatatgattatcgaactagtatctctttataattaagtatttttctatttttttttaatttagatttttgtgaattcatttacagtagaaaactgtaaaaccatatggtctaattatagaatgaaaacttcaacgaatccatacaacttattggctaaatataataaatctgcttgaagcatattgttattatttagttggatttgacgatctctgactttaatgtataccgacataccctatgatttagatgttgatttttcccattcttaatatatccatgttaagagattccaccataacatatctaattatttgcattgtaataaatattatcattaaaaaaaaatacaactggacagctggctcgtcccattgtttcttacgtccaccaattacatttgttaaagcaaacttattagaacgttcatgtgtgagaagttggtgtcgacatgtgtctaaggtctatgtcagaaatcggattagcttattaagtaaactatactatatcattgttaatatagataaaatatctagttcgtccaaattaaactattttcataactgccacgtggcgtaaacgtatccatcgagtcacttgtaatatctttataaccaaagtcttccaacacattcatcaccatctatctactctttactctcttctcttctcacatcaattattcatagttctctcttctccggcaagaaaag

SEQ ID NO: 404 - DNA, 3000 bp, Arabidopsis thaliana
agtgtaatgtagcaccctagttaattttcttgcagctaacttgagtgttctggataagcagtaactttagccattgttttgtatataacatcttaagattttaagcaacacttcaaattttttttttggtttataggtgggacgatgtcaatgagttattggaggagatgctttcaaatagagtatcaaatattcatcaagttattgggcaaatgatcaagggagattatgatgatgactcaaattggcagatagtggaatacgtgttggacaaactcaattcagaaggatgtggtttgggaataaggttttacaatgcacttctggatgctttgtggtggctgggccagaaagagcgagctgcaagagtactcaatgaggcaacaaagcgtggacttttccctgagttattccggaaaaacaaacttgtgtggtctgtcgatgtacataggtagcctaagatccctacactggcttcgtttcatgtgtatgaaatggttgagtaccagtcaatctaattcttggttttcaatgttctgcaggatgtcagagggtggcatgtatacagcactatcggtttggctaaatgatataaatgatatgcttttaaagggagatcttcctcaactagctgttgttgtttcagtgtaagtattttgatactgggtacctacctcattgcaagatgccttcaagctttttatcttgccttttgccttttttaattctttctttctaacctctcagacggggacagttggagaaaagctctgctgcaagagaatctcctatcgcgaaagctgctttctccttcttgcaggatcatgtctcgtcctcattttccttcacgggatggaatggaggtcgcattatgtgccagcgatctcagctcaagcagttactgtcaacgaaagagccaacttcagaagaatccgaaaataaaaacctagtggcattagcaaactcgccaatatttgcggctggaacaagagcttcaacaagcagtgacacgaaccacagcggtaaccctacacaacgaagaaccaggacgaaaaaagaactagcagggagcacagcttaagaactagacaacgtagtttctgttgccaagtccagaaatcaaaggcctcttctgccttcctccatatagactggtgggtgaaaactgtgggcgtatttcacaagcactccatatccatgataactatgctatggtttcaagcagtagagtcaacctctgttagacagaagaagctggagaagaagataaatggtgatcttagtttatatgaagaagcgtctatatgaaaatctcaagtaagtagccaactaagtgttttgatggattgttagacccatgattttgcagccatagattttttttcgtttttttttccattcaactatgtttttgattactataaagctaaatgctaatgtaagatcaaagctctagttacaattaaaggatctattaatcaagattcctcagggaagctctagtttttgcttgtgacctcacctgatgaactctctctgtttcgaaatctaacttattacatagcaatgacccaactccacccagaataaagaaaacaatctgttgtgcaagattccttcttcggtctgattaatctttttctctctctcgtcctcagatatgtgtttgttttctgatttaggaaagtcactacaagtttgtcatccaaattggtaataaaataagaaaaagattggagaaagaaaggatcttcctatagtgcttcacacattacaactttaagattccactttgtgtgcgcataaaagtaatggtggctttgctttctaaccgatgctagtgctttgtgtgattttgctgtcttccaaaactatttaccaaattttgtaaatactttttagaatcttttccctacaaatctaaaatagataaataataatagtatgtgatcatattgcttacagtcaaatcacatcctaacattctactaaaagactaaaactatcacctttttgttttttaatgctatatagttgtgatcaagtctggacatacgatcatgctgtttatactacaattaggtccttaacagcgtcttaaaatttactcttagctagaaaacgacaaattcgactacacaatcatttttgttgttgaattagattcctgaaattgtaagtttttgtgttgaaattcaaagttataatttccaaaaaggattcacctgtctcccaagatttttttcttaataatcaactcatagatccacaagatatagtattttagaagaaaaaaaagtacaaggatggagctgtaactaaatagattattagagcagagtacagaatcatttcagaagctgactatttttctaagctcaagttgcatgcgcttaggccttagagacattgcgttgaccagtacattataacctgtagatttttatcataaaaatacatgagggtaacgttaagaaaaataaaagcgtcgatttcatttcatttttctcattctgttatttcatttttttgtatttaactttgagtttgcgaaagtcaataaatatttcttcgttatacgacctacattttttggtcgacatagcgaaatacttttttaacttcttattataggataacatttatttaactcttttttcgtcatcctataagattaattaaactactaacaaaaaacctaataaatctagtcagccaatgaataaaaaaagtctatccaaatgaaaactctgtagagagacaggcaggtaagaaaaaaatacaagaacagacgaataaaaacaaaacacgtgtcatatggtaccgtcaccaacacctacaacatgtaatagtttaaaaaggaaccacgtggcttttggcttataaaagggtccccaaagaagctcagatctaactcacaccactccattgcccattgctctgtgtactttgcttctttaggagaaagaaagcacaaggggcaaaatcggaaagattatc

SEQ ID NO: 405 - DNA, 3000 bp, Arabidopsis thaliana
atggaaggttgttaccggtacctaaaggaaccgtagcaattggaggtggattggataaattaagatcagaaacaactccaaggagccaaccagctgttccatctccccctgcaacctaaattaaacataactcatgcttaatgacaaatgactaaattattaacaccttttctatttacgtaccgatgaagataactcacaatgattttcaacttgtcccgaatcttgctagccaaactatcgtcttttaacctctctaggttaagataaattctctgcagcactttatctggggtctctacctccagatcaaaaacctgagtaccaaatatgctataattaataaccaattaaaaaacatggaaatataatatatgataatgatcatcagtaaaataatgtagacagttatctaatttaattagtttccatatttcaatcaagtttgatttttagggtttttaggttaaaatcagatataaaatcaatcaagttacgtatttaagaagaatcaacgaattcatcactttttgttgtagaagccaatttcaaaaaccaatgaatcattagtctatggctaaagcctaaattgatatattatagacctgcttgtcgttgagcagagtacggtaggtaaggatgagttctgcacctagttgacctccgcttttggagttgatgaatacgaggattgggttctcaggtgcagttgtacaactgatttgcgcctcaggctcgtcttcaggcgagagaacgtacgaaggtatgaagaatttcttaaggaaatctgataaattcttgtatttttccatactcgtctctgactgaaccattcacatatcaacactcatcaagtattcatatttaagattaatcaaataacaaatatataaaatcgacatcgttaatcatgcaaaagacgatcgaagtagacatcataccatgaaatctctcaaggggttgaaagataaagtttactatattatcgtgtcttgaaaaagtaattagatttaaataatggagatcctgaagattttataaccttttgttaatggtattgctataccaagactaattaggagttagaacaaggttaaaggcacaacgttgattttcctttttcttttatatagataaaaacactagtactcttaaatggtctttatgcacatgaaaacgtgatctttaacatgcatatctaattagtaattactgctttttttgtttgtcaaaaattacagtcttttttcattactttttttgttaaaggatttatatctaatttactgctgacatatggaaatggagtccattgtctttgtattatatatcatctttcatatatttcatacttttctttagtttaatatatttataccaatttatacatatttagatattctacaaatattaattttttgtcatcatttgttttatattttataacatttaacttattaaggttaaacgcaattacaaagtgtaacttagcccgtcactgatgagctcatttttacaagcaattaagcccattaagggtgtaaagcttaattccactaatggcccattaagtaaaaagcgctatagtattaggccttgttcgagaatctcctaatgccatgacttagacacaatctttggacttgacatcaatacatcatctctgacgatgaccgatttcctttggtaaatctctgacgatgaccaatccagaagagaaacctaagagtagatagaatgatgcaaaaaagaagtgaaaggataaccccacatcacatctctttccatgtgtcaccttctgcatgaatccacacattgctattttaagaaggtgaaaatattttaaaatgtagacaataagcttcggtgtgaacttcggagaagcctgtggttcttgtgataaaggggatatcgaattcaaagtttgttgcactgctttccaccaacaatttaacaaacataaaaaataaaataaaaaagtttcacttcttttgcaattttgtagttatttaatttgctttttgaaatcgtctaagtagtgccaacgtggatggcttgttcggagagagccttccacaagcaattgaaacttggaataacgttgcataagtaaaatgttgcaatcatcaattttaaaagcacaaggcacatgacattaacacgttatttgaaagtttttttgatgagaatatccaactactttaccgtcctcactctcttaacctttgaaactctaggctttatgttccaaaattcaacgtaacatatattctcatacttaatttttcaggttttcttaaaccaaacattatgtaaaagtcaacttacctatattaacatgcaaagtcaacatctctttttttgtttaagcaaagtcaacaacttaacccacaaacaaaaagcaaaacatgcaaaattattaatgtgcttcactctgactctcaccaccataaggtaaacataaaatactctcaccgccgaagttacccccacaaggtttctattttaatctcttagttccattactttatctacattaacatacaaaagaacattctatcactccaaaatatacgcataaagatattattatttgaactaacagaatctaagttagatagatagattatattaaataccatacatactatcacgtggatcgtttctagaatatacagtaaaaaaaaaacgttaggcgatatgtagtctaagcaaggtttataaccttttgtatatttcaaaggacgtggcatattaggtacatgccaagtggaattgaccttggctctcttctacattgataaagttcttcgcataattcacatccctatataaacaaatgaacggagaaggtatgagtacatccacacattgacatttctaaaatccaactcctctttttgaaaattaagaaactccacttggctcttcgattttttctatctaaataacagaaccaaatcattatcgaaatttaaagttgtgcgaaacaaaacaaag

SEQ ID NO: 406 - DNA, 3000 bp, Arabidopsis thaliana
tattacgaccattgacaattcgtagacaagctaacctcctcaagtgtagccaatggttggggaaaatattacatcatttttatataaaaagaaactgttggagaaaatatcctaacagtttcaagaaaataaacaagaaagacaaaaacacaagctcataaaataaaaccagtattattaataagctaactccacagttaagaaaagggaaatatgaatttcaatttcggaatacaatttttttttttcaatcttaaacttgaaagcattagttaatttaggtaaacgaattaaaaaaatagtttagatcaacctataatctatatgtaataacaccaaactgtaataataaattaaagaaaaaacacctcactgtctaccgttttgaggcataaacgcaaactccaaatcaccattgttacctccataacctcgatcgttcctagccatcagattttcattcgttaatttccagtcagccatagccatctcatttggaaatgccggaagattctcaaccgtccgatcaccactcatctggtagatcctcgtcaacaaattctcccttaacacactcaaggcattcttgtactcttccatatgctcctccggcacactctccaccgctctctcccaccacatcaaaccgtcgttatcttcctctccgtttgccacgttaccaccgggatgtgacctcagcatcaccggagccttacgcaagtatttatcgatgagtgagttcacgttaccaaacgagtagatcctatcgcaacgtgaaaacgttatgataccaatctgtgcgccgcagagaacgcttaattctgccgcttttttgaaaagcccggatcgtcgtttggaaaacgtcacttgccttcgggtctccagcatgatctccttgatctctatcttctgtcgacctttggtggttttaggttttttttgtttagtctctttttttggtttggccagcaagttagggttttgtaggggttttggttccgtggttggtaagaaagtgattgttgaagcttccccatcctccatattgaagacaagaagaacaagagatttttgtgagagattacaagggttctttgggagaaatattccgaattatatttatattcatagttttgaaccatataaggaattattgtctcatcataatatatgctaattgtggtattaaatgcgcgtctcaataagttaacatgatatttggaatgattccataaacaatcaacattaactttttttaatctaagtttcgtgacattatttcaaagatttacgagatatacttactcctttcttttctttttggacaaacaagatgcttactcctctctattttacatttttgttatatataaaatataaaaaaaaactaatgatgatgctaatatatgtgggtctcatatacgaataatatatgatcaaatcaaatatatatatatgcatatgagcatatggatgttaatgttattgtcaaagaaaacactggccttagtatagttgaaattacaaagtatagttgccacatgaaaggttcctcgtggccattgcgaatatttaattcctttaaaattattttattcttttccatttaatatatcaattagtctttaattaattaaccactccacaaaggttcaaagtaaggttgatagattagtttagatttgaaaaatggttagtggagaaaaccacgggttcattagtcagtattagagactgcttatggtttcaaattaaaagctatacccctaaaggtaggataacaactactattacaaattaattaatttttgttaaatctatatatacatttttgcagccattttgttaaataaatcctgtagttgagatttatttacaatggttgtcactggattttaatgtttgtttttgataattaaaaagaaaatcttcgaattaaatatttgacatttaacaatcttcccaaaatctctccacattaactacacgattatttactaaaataatacttctaaaatatttaatatcatttaattactacaaaattatcatttttgatattgcttttctccatgactataacaattcgattataatcatcaaagcgcagagatataatctgatagcatttaattactacaaaattacaaaatatttagacaatgattcataaacatatcataaataagatcaacattaataaaataaatgggtttatttttacaggacgggtttggaaggacgttacttaataacatttgtaaactataaaataaaattattttatagataaatacaatttataaacttttatatatactaactttaaaaaataaattattcccgcgatataccgcgggttaaaatctagtgtatatatcaagttgtagcaaaaccagctgttggtatagttttttcattaaagttgttccataaaggttttaactaatcaccgtgacgactaaacacattggttaaaagttaaaacccatgtcgatttattgactcttgaaaggtgaataagccaaccattactataggtataggtttttatttttatttatcttatgccaaaaatccaaaacgactagtatgacgcagtaaactgggtagatataagaatcatggtcattaaaactcaaatatacgattcacttaatgtaagatatgattaaagataagaatggattaacccccaagtaaagcgataagatcgaatatattaagttcataaactcagctaaatgcagatcattacagacagtggcgaaatcatttaaaaagggattaacctatgatgaggataaaatggtaaaattaacaaagcccacttggcccaattgtcgttccgaagaacacgccttgtcgctctgcgtataagagtgtgctcaggcaaaaatgaaagaacaaaaacacagagacacctttaaaattgagaaattttactttttagcccaaaacttttaaaacttatactttgaaccctttagttctgagaaa

SEQ ID NO: 407 - DNA, 3000 bp, Arabidopsis thaliana
tttcaaaaaatctaaaaatctcgattctgcaaatttaattatttccatcctaagcgaattattttattttatactactatacatttcttcaacctagaaagacgctcaattttgaaccttctacgaaattcctcaagccaaagccgtaccaacgtaccatttctttatccatgataaaattaattgtatctacactgtatacacctatctatctacatatattatattcagaattaaaactaattatagatatcgtatgataatatttgtaatggtaaggccatctctttgttcggttgttgggaaagtacggaggaagtacggtgccagtgaagctgcccattatgggaaaccgcttcaccaagattattgtcttatttttgtgactttcggggtaaactaaaacgtcttcattgccaaaaccgtctcgagatgctattagtttcttcatgcaaaaaaggaatatttttgggctggaaagctgacaaaaatggcctctgtttgacctttttaagggtttgcttaggaccaaagtgtgaaatgtctaagcgaagacatgtctcataaaccctcaaggctttgtgagaaagtcaaggctgtccccaaaagaacatgccatctctcatcaactccttcgatcatgtgctcttgcgtgtcttaaagttctatataagttttttggcttttgccgaaatacacatgcttcttttgaaatcatcattttgctttagtatctatctacaaatctccatattctcacatgcatgcacttatattattgtggtattatcttttataagtatcgagagtcttctaaaccagaaaataatctaaattaatttttcattacgcagtgattatacaaatttattgataacattagattgtagatatatttgaaatatacgaaataatatctttaacaaacaccttataagtacttgtcgataagcgtcgatctgatggagtacgtatatccttttacttgtatgattgttatatacatgcagtttggagaatttagacaatagtcatgcattttttactattaggttgtagtatacaattaagaaaatctagctgagtagcttagctagattcgacgtggagaatctcctcaaagtaattcacaatatcaactgtatcctatctctaaaaagagaaaaagggaaagttaacttaaagtaggcttaagtatgatgtgtaattgtgtattgatatgcatccatgtgatacaaacacacacgtgattccttcaatctctaatcccacgtaactttgtttcgcctttctttttcctaaaattattagaaacaaaagaaaaattaagtggttgtactccataattttatcaaaatttgacctaacctactactgtatgtttctgtttacactttacagtttgttttctatgtgtgttaaaagtgttgaaaacgtatgataatagaaagaaaaaatattgtcatcgagaactgaaataaaataagaaagaacgcggttttgtgccgcagcgagacagagtggaaacagctgttgttgaagtgattaattcactcacttcagtcttcactatttggctgcgcgtttccattttcattaactattttatattcgcaaaaatatctatttatataaatatattaacattttagagtacaacacacatatatattaaaatgtttagacttttcataaaagggtttaggtttattttagtttatcatttttgtttgtgagacctcactaagacctcacatgctacttcgtgaagttgcctccccttgtccctccatatcagaatcctatgtattttcttccctttctatattttatttctttattattttcattaattattcttctatttttagtgaaaacaaaagtttacgattcaatatttagcctataatcaattttaaaagatgtatattataaaaataaactctacaatttcttaaactgtgttatatttagatgtcatatagatttggatgaaaccattttaatttgataaaggtcaatctgattaaagaattaacttttgaaaataataatacgggaaacatatataatattatagtataatagcattcttatgcatgttatcttagtgacttttttattttgtattagtgatttttttaccatccaccaatgaattaactcgtttaatatatatatattttttaaaaaacataaagaccaatgagcaggtttgaagggttcttttcctcgaaagatcgtaggattaatcaacacattatattcaaacgcagctgtaatttgcaattgcagaaagtgatagctataagtcatcaaaaacataaacttcattttcttttgacaaaaataatctcaacctcaatactaatcctcaattttcccatcaagtagcttccgtacagctagctgtacactcatagatttttatattttaaatgttaattaattcaatggttactttcaagtttagaccaatattaaatatttactttaaccttcatccaaacgtcacaaacaacgtgttggaatgttacttcactaagtcggcgttcaagtagtggagaagctcgtaacgagaatttagctttttacatatctcataaattagtttgagattcgtctccgtgcaatgatctatcttggtaccaaaagaaattcttacaataattaatgaagattaagcttactatacataagaaacaaaatctgacatatccatttgtgagtattcgggtgaaaaatacttaataaagaaaacacctgtcatgcaccaaaaacgtcatattgatacacaaaaacgatactatttcatttgaccaaaatttaaatttattaaataaaccattattgtccccctctatcacaatccccccaaatcaaatcatgctatatataatctcatttccttgacattatttgtcattcagaatacttttatctcatattcccaacacttgttcaagcatatctaagtcaataacaacattacaacataac

SEQ ID NO: 408 - DNA, 3000 bp, Arabidopsis thaliana
cggcaaggtgtctacattgctttcttttaagatctccagatattttaatgatacaaacaagtagctttgtttataactattccttgcatgattggtaattttagctaggaatcaaatcactaacgatacaattatcataatttataaattatatgttttgataaatgattaagctagtctgttactatttgattaatccttttatactatctctatttagtgatttttctctcttttatcaacacataaataaaaatgtgacatatgaacgaatagagacacaagtctcccacattaaacttctatgcattgatgatcctcatacggttggctatgtcgtggtactataataagtatcgagccactaaagatcaattgattgcacatcatatttcatagatgaattaagcaaaactatcaaaatagtcgattatggtttctcaatcattaatcaatataaagaaaactaagtgaacaaacgaccatgcaagaaaaacaaataagcaataggcaaacaactatatgacatcaactattgattaagctcgggttaaagtgtttctcgttgtagcatttttagtattcaatttatcctaggttctagagctagaaaatcatccaaatgaaataatatattttttatgcatctttgtacattgttgttcaagtttgagatccatatattattttcaagaataaaaaacttggagtttaaagtgtacatgtaatttttactctacataatgtaaagtaacgttgtccacataaaataaaaatccatacatacgagaaagagaaaacagaagaaaacaaaactatatacaatacacaagttgttaaataatgagagaatcacgtgttcttcatgcacatgtaagagactatgaaataaggataacaccgtagataatatcttattgatcaaatgaagcctaatcttttttttaagattagcgttaagacagatattctctatatttgagtaaatcccagccgttggatcactgacctataccttattgaccaatcccaatcgttagtacaatgccgtccaagaaagagagcttgcaatcgcatgttttagatgtatgctattaaccctaaatcctcaatttctcgatctcaatcttgctatgtggtgggtgatacatcaatggtaattgatatattattcttttatatatttgtggttttgttaaagaaggtatcaaatctgatgctctgaaaaagtgtgatttttttactggattttagtctatgtaagtatgtattatggacagagtttaaacttgaatccgaaccatttaagaccggaaaaatttcatgctattctcaaactaaaagaaacgattaaccataattagatctattaaaagtggatacatcaatcaaataataatatgggctgtgataatatagttgtatcaatactcgggacaaaaatgcaacacgctacaatggtagattcaattataccgtatgaatgaaaacattgcatgtgggctacttcttacgaagagacatgttcacttccaaaactagtactagtcaaatgattcgacataacctgaataccaaatgctatatcaaaaatggcaaatattcaactaataactaaaaagaacaatacttttaattttcttattaaaaaagttctagataataaccttttgagatttgattttcgaagatattaataacggcagattactaaatgcaaaattacaagaaaaaaatttatattatgtgattttctagtaaatgtcgattctaccgtagttgactacgtgttggcgatgaatcttctgagcgaattttcgggaaagtttgacaacatcatctatgtcatcaatcaccatcccccgcttcactgaggcatgatcaatgctctcatggtagcatacaaagtcaaacataagtcatactcatcacccacaattctacaacaatatgcttatcataggacattaaaatcaaggacgaggaaactacaagagctaaagacatcgcggacaaaaccatataagtagtggttaatacaacaaccgttcactcatacgattagcactataataacacctcggtcatatacactaatcaaaaataccaatccactaatcctagacctatgactcaaataccatctgcccatgtccaagtccaacatcccatcctctaatggcatacttggaccaatatccatcaagccaaattggtgcacacactcaatctcaaaacacaccaacgtacattcctaattaactcatgcaatcaacactatgtcaccccaaaacccaaaccaaacgacgtgaaaaaacatgtaacacacgaaccaaatcacattttactcttgttaacattaacgaatcaactacacctacaaaaatctaatgtaacaagcatgggttaaaaaaaacaatactgcagcgatcattactcttgttttggtcggaactaaaagttgatgtttcatttcatgtattgtattgtctcctttgaaaaccaaagcattgaccaaaagcagtacgtaccggcaaaaaaaaaaaaaaaaaaaaccggaaacttacttagccggtataccactgccaaaaaaggaccaacaacaatatgttaaaattttattataaagttattatacacatttatagttacagagagagaaaaacaactttattataaataatgatcatcctctaaaattgggtctgaaatgttccctcacacgtctccttctatcttcttctccactttaaaaaaaaaaaatatccgtctcactctctcgccgccggtaacatttcccggcgacaaaacttctctactctcaccattcctccatcgtaatctctaaattcttctccattctcttcttcctcccgatcatctcgagctcttcgtgagagattatgtgattatgtaatcgttgttgctgtagaagacgatctctaacaactgattccttcatcatcaccttcgctagatttgtaattttcagagcttgag

SEQ ID NO: 409 - DNA, 3000 bp, Arabidopsis thaliana
aaatagagactataaacataagtgcataaagcacaaggttaacaaagaaattgacccatcactagtaatattctgataaaaatttcaaagcagttaaatatcagagatttttgcatatagtacacgttcaagtattttaaccatttcaagaaatttgagtggtagacaatatttcaattttcgattgagtaataaactttgaagtgtgtagatgacttcaaaacacattatcattgtgaattatagggtaatacgttattgtgcaatgcaagttattaataatgtaagaaaaaaggttactcttttacctattggaactagaatgaacagagatatttagtcttaccaaataaggaaaggccgattccttaaaatctaatattttcttgcatatctggataaattgaacggctgggatttgagaaccaacttatcatcaaatctatcataattatttgtaaaaagagagatatagatttggagtgagtgattggtgagtggttgaataatatgacaattgacataaccccactgtccctctgtctccattaaggtttctctctcttcctactctcaatacaatagtagtagttggcatattggacccatcctttttttttggtttaggccccaaacgtgtaaacatcacaccatctctcttattctttattcattgactataacacatttatcattttattgtatagtttatgttgtggtctagattatcatctttcttgttcctccaataatttggaattgaagatccatcccactagtgataaagaagaagaaaaaaaaggcttgaggatgaatgtgttaaagaaggatagttaaaatattttaaatggtttatttaaatttatgacagtccatttgaaactccttttcttcaccaatatttcagtataaagatgaaatgcaaatggtatctccttcttatagattaaaccataacctaaatcaactcttacgaaatctcagttgattgtgatttatgtatattgggatgcgaaagcacaacaactaggtttaatttcttctaaaatgtgtgataaataaaatataatataaaactaacaaaaaaaatctgtcggtctctctaatttttcgttgctatgttttatccatatatcgtaatctttaatttaaatggaaaagggttgtcctttggcaaaataaagaaaagaaaaagaaaaaaagatagagaaaggattgtcctgattcgttaaatgacgcatagagaaacaaaatcacatgtgggtttatttaacacgttgagaagataccattgcgacgcgaagtaccaaaaaatccctgaccgttagattttttttcatatcttgacacgttggaatcacacgagggacctatcaataattgttgtcgctaaatgccaaatttaatgaattttatcgaaaaataatgacctaattttattactaaaatgcagagagtagacgatgttaaccggttaattttgttgttgaatgctttaaaatgtgaaataactatgttgaattgtgtttcatattttcttttttaatcgtataatttactaacatgttagaagaaattacaaattcagatataatataaaaatttatttatccttaccaaaaaaaataaaaaaattatttattggattttacccatctactattcattctcatcattaacttacgttttccgaaaatcaaagatatttaggtcattttatgtaaggaaggataaaaataagtaatgattaagaaataacatttaaaataaaaaaaaattgacaacaacggctcattattcctcaaaattctaaattttgctgagaaattgtgttaccaataacaaacataatcgcatcgataatcgctatataatctgttgctaattaaggataaattgaaaatttgtaaaagtcggcaaattcctaatattgctagatttaggttgttgaaaatttcagatattgactttttagtacttttataattgatggggctatcttattttcaattatattttgtttgtggtcacactaggcctaataacgtacacttgtcaattaagaacaaatttataatcttacagacaattccacattcgagcatgcattaacaaatttcttcggcattaaactatatcaaattagaatgctttggtttgaaaaataaaagtaataacgcttgttttttgatataatgcatagaaattaaaaactacttactcttcaaccaatcacaatataatacgtcctttaaggtttgacttttggttttgatcttaatactaaaacaacattaaaaaaaaattcttaaactctttatgatgttatctattttgttaaacttgtcgatgacttgatcaaaagatgtatcattagataaatcaagtagctgtattttacgagggaaaaataatctatcatattatattcacgaggtctctttaccaagtagaaggctaaagaacataagtaatagtataagctagtatctttatactttactctcctcacctatttgatggcattagttttgtttactattttaaaattacaggtcgacttcacttaaaaggaagagaaaacttttgtttttgttattacatcgtattaacgcggttgagtttacaacatcaaaagtgttaatatataaaaactcatcgtacaaccctatctacggctctcccatatttaattaacaaaaatgaaaactaatatatagtacaaaatatgtttattcgatacatcggcaaggcaagtacaatcatataattatagaaatcaattttatatataaaaaaaaagagttgaaaaggcaaataaagggcaagtgtatccaatgcaaccttcacagtgaacacgtcccacgttcttttttttcttccctcttttagaactctctctctctctcgtttttgacacttatcctctctcttttttctctctccctctctctctcgccggaaaaaagaacaacgtcgtttatagctaaagattcgatc

SEQ ID NO: 410 - DNA, 3000 bp, Arabidopsis thaliana
ttctaaaaatcttattcctctgaagtactttccaaagttcaagcaggctgcatcaggtggccaggtgaatgtggtcaatgtttagtactccttccaaagggagatagtccaccagagccttctcgtggatggaatgaagacgagagtggatttcatgaaatgcatttgaatttcgctttttcattgtacttagtggataacaatactgcttattataattcattcaggttaaccacaaagacagagtagtaagaggcagaagaaagaaagaaagaaaaaaaaggctcaccagctttcatatcaaccctctcaaccttgccgtatttcctgaatagtcgttccaggtcaccttcgcgcgcatcatactcaaagttcccacagaagactggcttcatgcttcctgtatagacaaccacaatagtaaaaaagattcatgagacttccttaaatgataatttaaacacgaatatcacaactaatttgtcaccaagatgaaaacttttaacactaaaaactagagccctcacactaaatcgaattgttttgcagtaaattaggacttgaaactcatctattcgagctccaaatcagttaaatctaggaactgaactagacagtattagaatcaaaagtacaatgcaacagatctaatctaactacagttagatctgaatatcattcacaagatagagaaaacgagaacaatccacgaaagcatgaatctttcataccagaaaaacaaagaaggctctgatgagattcaacttataaaaaacgagatggaccaattctcttgttctacttttcaccaaccaaaaaaaaaagaaggaagaaggagatgagaaccacgacgatatagagagtgaataaactgcatcaatttacctgtagaatgattttggcaggcgtagtcgcgtggaagccctagaagaagaagaagctcgcgtcgagagataggtgaaactgaaaacagagttaggtacgatttagataaagaaggcaagagagatcatttggatttttattttattttcttttctttttagtttcaaagatatttttttcagaacacattttgactttcttattttgtctgaaggacgagaagtcgagaacgtctactttttaggagtattgggcctatatgttaaacaaattataagaagcccaacaagtaaacaaaattgaagctgctttctaaaaaaacaaaacaataacagattatgaagacaaacaaatattagattttttaattttgattagaatatactgattaatagaactagaacatgtatcacataacatctacacaatgaataatgcatacaagtttttaaaaagtcttgcaacttaacactctcaagatcccacatgtcaagttttggattcgatgaaacatatgagtttgttagtaagtttaataattgttgttataaagaaatgtgtatatttatatattacaattaattaaataaattgttttcctcttcattggattgcttcacttatgttaagagtttagtagttgctttcaaggccgaatgatatgtggccacgaacatatcatcacacgtggaatgagaacgagtttcgacttttcaaatatgccataaagcctcaattatcttcttatctcgcttgaatatgcaacaaaaagctattaagatattcataaaatagaggcgtctcaaatctaccaacaaaaagctacaaaagatccagtccaatccactgaagaatcccaaaacagagtagaaacccaaacaacccgattcagcaaataattcaaaaacgaacgtccgtacgattttccaaaaacagaaagatgggttccacaagataatgcgtggggacgtcaaaatcctctaaacccgtggttcggccgcggaaacactgtccctaccttccccaccagccttcactggccccatacgtcactctcaagctttactttctattttccactaaagccaattttgttgttttcttcaccttaccactctttttttccctctttgttgtgtcttcttttctcctaaatgtcaataacgtgagagcgagaggtaacgagagagatatttttgtcagcgaatatatttcatgcatatcttattgtgaagattttttataccttttttttgtcaatacaatatagctattattgagattgagatattttgtgggaattattgggattcaagataacttgctattttgtattggtctaatccttcgcttagtcctgtcctggtccatttacatgtttttggttatagtttgtttaaactgaataattttgttcatcatatgcatttatgactcatttttaaccgtccatcgaaattgataattatccattaccaaatctgattaatttttttaaaaaatcaagcttttctatattgtagtattatttttggttaaatattaggacatctacttccaatacaaatactacatgagtatttaaaatatcatttcacagagatatttatgtctattatgttatagacgggtgacaattaatgacaatttgtttattcataggaatttaaaaacgattgtaacaacagcagccagccaaccacacaggcacacactcgatagaatttaaagaactcataaaggttaacgagtgaagagtcaaaagtctctttacaagggtcaaaggacacacgtcagacagcgagtggaacatcgtgggattgcttcgctatgtactatacacgtgtcattcacagagacaaaaactccgtgtgctccccacatatccgttatctctcctccggccaatataaacaccaattctcactctcactttttatactaactacacacttgaaaaagaatctacctgaaaagaaaaaaaagagagagagatataaatagctttaccaagacagatatactatcttttattaatccaaaaagactgagaactctagtaactacgtactacttaaaccttatccagtttcttgaaacagagtactctgatca

SEQ ID NO: 411 - DNA, 3000 bp, Arabidopsis thaliana
gtttgttattgcatcatcccactcaaaatatgtacaacgtgtcatgtaaaaagcttttgaggagcttagatttttagatttcattgaaagtttcactgatttttcttattttattttcacattcatatcgtcctactctatttttctctaattatttttttgtttcctacatcaactaatttgatgtttaattacatttgaaacatatcttatgttcattgaaaattatttaagattttgaccgacatatgggattagtaaaatatatcagcagctttagttatgatatgataaatccactacatggaaatatttgatgagtttggaatacactgaaaaaagacacagaattcttcaattcctcattcattcctttagaataaatcattgcaataaactccaaaaaaaactcgatggtaaaatcacaaagtggatagtgacgtggcaacctcaaaaattttggtttcaatttttttgttagcccatctttcttcttggacccaacaaatacacgaaaataaaattattcatgtttccctttccgacacaagtccatctccttcatctttcattcgattatttttgtggagatttttcagttagtaatagttttaatatctataaagattaaaaaaatattatggtgatgtaaaggatgacgaatttgctcacaaacaaataaaatacgaatctaacaatccaaatcttataattatataaaacaccaaaatgtaataacagttggctccagcattctagtcagaaaccaaacgtcatctcgagtcgtatctcgtgttcctcacgcgcgtttataagaaagggtgataaacacgcgggttttagagcgcctgaagatgaaaatacgaggtatagagagaaacgaaaggttattggtggatggaagagggaaaaagtggaccccatagtttgtccgtactaaaggattgatcttttctggtaacattttcctttttctctcataattcctttttccttttttcgatacctcttcctctctctaataacaaatcaacgtttttttgttttttgagtatttacgtttatatcctcgtagtcctctcatattttcagattaacctcaagggttttatatgggccactcattcttatgtaatctctccctttcttaatcgattttttaaatcttttactgggcattaccgatcaagcccgattataataaacccaaatagaataattagtaatctggtttggtgtatatttcaaattagaacaaacaaaaacaaaaagcaaaaagtttcattaaaccgaaccaaatggttgtaaatcataagaattgaatgcctaacctaaagcaaagcaatgcctcattttgcaccaaattagatggaaactagcttatgatatctcaaaattagtttgttcctagcaagttgatgaagcaacttgtgagctatttccactacgatttcgttctcttgagtgttttggttgtaattaattttgattaggtctaaaatcttcgtgtcacatgttctgcatgtacaactgtatttttcttgagaaaaaaagccattgcacaaacttcagttcaaaacattttgtgtttcttctatcaattattactatatagaaaaagtttctctcttgatatttgagtttaaaatctggtaatcatcaatgaatattgtcaacagttgttaaaatcagcaactttactaaatatgaacagagaatgcaaatggtggaagtttcacattatattggcaagtgtagaaaaatgtctgaaagtatatgggcgactgggagttatcattcattaagaaaacaaagaaatctagatcgttaaattctacggttaagaaagactttttattatggtaaagaaaaatagtcaaataaccaaagtaagcaattaatatagtttgatcaatgagttcaaaagcctttggttggaataactcattaagaaaacagatagtttaaaatcaattgaattatgatttcagacatagtataagtttgggcaaagtattttaatggaaatagaatacaaacttgataacaagttattgccatttagaaaatgttataactccttatatagtgagaaccctattgcttgcttgtgttcaaggaattgctgtttatggaactccactttaaataaacatataaataatctatttagtatcaaaaacttaatatcccatctactttgaatttgcccgatcatgaaaacacctatttattgtacataaatatacatctttaacaaatatagatctatgcgtgatctatttgtatttgtatcttattaccttttattcatatagaaaaaggaaaaaacaaacaaaaagctttgttccaagagtttaaagtatatcaaaattggcaaaattgtggggttttgaagtaatctactagattattcattttcttgcaaaaaacacctttttatagaattgcttaccgaaccaagccgtggacttcactttcttaaaacatgaaattacatattaaaggaatcttttgattaatcaaagaagatgtttgtatacatagataataaatgaaagtggaaatatttttttaaaataaaaataaaaaaaataaagaaactccaatacgaggaattgtttcgaatataatcttttttccaaagaaagcaagtggttagagagagaataatattattttattaaatttttacaaaaaaaacagtgacaagagaagagagagagagaaagggcagtggaagtaaatataaaggaaaggataaaaatgaaagctttcgtagaagcaatctatcaaatttttattttattttcttctctctctctctttagctcttttttttttgttttcattaaagtttttattttattttctaccaaccaaaagcttttctctttggtttctcttatttagcttctaaccttgaggagaatcataccagaggattgaagtttgaaccttcaaagatcaaaatcaagaaaccaaaaaaaaacaaaaaaa

SEQ ID NO: 412 - DNA, 3000 bp, Arabidopsis thaliana
tgtaaatgcgatttagatattggatgtggaagaaatggtggagaagtttacgaatagcaaaaccagaaaatttatcttatttggttataatgcggttcttgggaataacacaatggttcttaatcaaattagctacttgagaagcttgttgaggtttacgtggaagcatgtgaagatgaaaagttgatgaatgaagcttgacaatcaaattttctacctataaatgttcgatctttactgtttagaatcggtgtttattcatgacttttagtaaaagtcttttaccgtgtttgctagtgtgtgtttttctgttttatgcttatgtagtaattttggtggtttatgtagctttaggtttctcatttttttttgttttcttttgtaatttttgtcaaaattttcaaaaatggtatgaaattttactttttaccaaaaaaaaacctaaaaataaaaaaaaactaaattatatattcattgtattggttcaaacatattcatcataaaatgtgaagaaatggattatcaatgtttagtccatatatctaagatgggattttttttttttttaaacactctaagaaatataatcgaaaatgttggcagagatgcccaaaattttactacaaaaacggttcaccaagcgtttaatgggctattaagacaatgttcatatgataggctattagcacgtgatgatggacattggacaacaaaaaacatgcaaaaagtaattagtcagatcgaagagcaaagaagcaagaaagagctaaaggaccggaggttgtcgtatggtgaaatgtggctttaatttaacgttggtacaacgcgtaggggcctgcatgcccatttttctaaccagtacttactctttcgttataagatatctacatatgcattttacacttaacattttctctaattgtaatcatgtgtatacgtccaactatgatttcatatgatcatctatcgagcatttttaatctcacaaaaactagtttctatgagaggattaatggatttttttttgtctagctttttcgccaattcctctttattatatttatgtagtaaacatgttttgtgggaacagtagagaactcgtgtcgagatataccttaaaaatgttcgaaaaccataaaggaaaaaaacaaaaaaaacaagcctataggattgaatattgtaatagtttaacctaacatatatcatatatgggtcatgggtgattggaggatgatctcatttcatttttgaatgattttgtgggttgttgtaataatgaaacaatataaagaaaagaaataaaaacaagcctataggagagtcctaccgtgaaacaaaatcgtgtaggacaatcattctccatatagagagactcgtcgtcttaccaagctttggctggcttccttaagtgctcaccattactccaatcaaagtatatcttgactttttaactctctcttttctgtcattttattgcctttttggttcatcttaatttagattttatttaacaaatgaaatgaaatcgcgcaaggtacgtgttcgattcgcaacctcgctttcgagtttattttttctaaacgtgcaaaagcgaaaagaaagtataaaataccttttggtacaactcattatgtggagttgatacggaggtgtgtccactatcaacccaaataacaaaaagttctgatttgttcaattcttccaattactttaatacgggattattaaaataccactatgcgttagaaaattaagtaggaagctcatatacaacaattttatttgttcaatgaccgttttctggttcaaggctttgaatactactaacatgtggttaaaaatcacgacaactaatcatcattcacaatcatatgtttatctattctttcacacgcacaaatatatattgtgaactcacaaataatgacaatttaaactttaaaagacaacttaaccaccatgttttttactgcaaaactggtgtgtagcattttcgtaaacattatgattcatttttagcgcatgatttttatttgatcaaaacataacgtgttatattgtccgataatatgttatttttaagaaaatccacgataaagcacactattttatatagagaaatgtcactgtttcgttttagcaaattataaatttatcatctatggtttagttatatagcttcatcctaaaatgtttttagtctggataaattacgattttaaagaaaataactatagaaaaggctttaaaaaaaaatcctaagaacttatactggttagtattatcaacagaatataattatatccgaagagatatctaatgcaaatatcttgctcattcgagcaatggaaaagatgtttttgtctcatcaactctctactgttttattagttactctatcaaaatctgagatttgcaagttgtaaccttttttcgtgtggctgaatagaatatccataagtcaagccacttataaccacaaagtctcaaaaaccaatttgataataccctgccgttcttattgttacaataaattactgctaattagtggtaactatcgaatcattaagtgtttagtttgcgattgattaccaaaaaaaaaagtgtttagtttacgatttggtcttcgtaagtggcttatctctacatggggttcacaaatctacttttaattaacaaatcttggttttgacattttaagcaatgagtagccagtttttttataagaattaaatacaatcaactgaggaataaggtgagagcaaaattgcaatttctctttatacgatcataaacaaatcataaatctaatcgtatttatgtgtaacagctcacatcttctaacaaaaaaacggagcttcttacgaatttgccacggttttacaatctctctcattcaaaaacatcatatatatacacaaacacactttgatacaacaaaaaaaaacagaacacaaacaaaaacacattgtaacattagtttaagcattaagcttcttt

SEQ ID NO: 413 - DNA, 3000 bp, Arabidopsis thaliana
cctaacaataagaatccaaatcggtgttctttttcggtcatatatcaaaaatataaaacaccgtggtagatacaatgaatcgagtaatcaacataaagtttataatatagatagaataatcaaagatgcaacgcttatgtcgtttctctttacaccgtaggtagatacataatgttttatattagtactgtattcgtttcggcttagttcatatatagtagctagcactaaaaagaagaaaagaacatagtagaatccgatttcatgtcgacaccaccttttcaacggaagtaaccatttcttaaatgtgtttgcgtcatcacgtgttatttgcgactaagcgggtgattaaagctgtgttaattatatcatttacttatccgtacagataagctctgataattaacgagatattaattaataagtaacgcattactaattttatttatatcaatatttctaattgttttgtcgtacatcatttcgatagacaactatcaagtggcgatacgaaattgtcaatcgttgagatatttatatatacaagtggccacagtttccagaatttattccattaactcataatctcatataaaacataagtacatgattaaaaacacaactactctaaatcattaaaatactttaaaagtcacaatttatgtgaatttacttctttttttcattttaaatggatacgatttttggtaccttttgtacatagattcttcattattacacatcgcacttgtgatatcagttttgggtacctagtttgataagaaattcttcttatttcttttcttgaaaaaggacaagttgatgaaaaagacattatcgtacgccttaacttaaattaaactgatcacgcctcgttctccggttttgccatgttaaacaagtttaatatttacaagttggatgcatattcgtataataatacgtaactaatccgaattgaatgcttaattgacgcgttgatgcgaacttaaatagggattaggttaggcgataggcacacacaagcatggtgaaaacataaatttatttaataatcactatgtttccgtatttggattgatctttgaagactcgatctctaaatttgttttattttactactaatttttatttgatagacatatttaggtatttttatcgcctaagtgattaaaagctactgtatgttttagtggaatataattaaactggattagtataaaacagggcatcttagtttctaaaaagggaaatgaccggtgaaaaggtttatccagttttttttttttttttgtcgtggtttatccagattaattatactgtcgtacaatatttttgttcagcttctttaagaaaataaactgtcgcactgactaattaattagttaatagagacttgagcatcagcctaagaaaaatgtcacatcaataacaatcgtttttttttctcccatctttgcaaattatgtattattagcttcgttaaatctgcgactttttaacaatacgaaaatgtctcgtgtataacaggtaaaaataacaactacgtcaacttgtgagcacaattgcttagattggttaaaaacaaaagtccaacgatgcgtttcgagattatcctcaagttaactctcaaccaaaaaataatagaaaatccaaaagatatcaatataataattattctgcgttcagactagaatctacgagtacatatctgcaagttctgaaatctgaaccatcctgagcttaattgcaaatatggacaacaatatgtttttcttaaccaaaaagtttttgtgcagcctctattagactcgattcgggcgaataagaaaacaactcttatagttaaaagaaaaacacatcacaaatcctaaaatcatattttcttctgaacaatgcgtttctattttttttctattttcttctgaacaatgcgtttctattattttcttctgaaaaatcgaaaacgaagaaaataatacaaggtgtgggtcaaacggtcaaagataagagacgaaggttgaaacaagtgggccgtagggtgaggcccaaacggtcacgagcattagccttaccatcaccgacaccgtccacaaacggagcatctgacgtcgaccagaaccgacacgtgcaacacacgcgcattcgtacggaacggctcgtctctcaacttgaccttcaagctcaccgtttagacaaaatgcaaaaataatcttattttataaatattccatttaatggttttacctctttttcagcaccgaaccgtaaatatagtaattaataatcgtttctgaatgcctccatattttaacagtgtttataacttcttaaagtttttactatgcaagttgtcttatgacacagagctaatatacataattaattcattaccttatttatttaatttactagacttgttaaagtattcttcagaactgttcatagagtataggtcgcatatagtatatttacaaaaatatataattactcacaagttgcgaaaagattcagatacgtttcatataataggacccaattttttacaaaatttgttcaaattgagttaaatcatcaaaaccaaattttcttctgttatagatcaaatttataaaaatagctatttgctatattatatatatatatatatatatataaacattagttattaaaaaaaaaactgcgtgtttccagttcacacgggtacagagagaagccgactcattttcatttggcggcgctgaaaccatacaaagtaattaacacaagaaaattaaatttgtatatctatcagctaaacctcgtcctttgtcttaaaaaacacatcttctaaaatctctgtctttctttcttcctctttgtctctgtttcttgtttctctctctctctctctacagagttttctttccctcgaagaaaaagaatatttttaaatttaattttctctgcgtttataagctttaagtttcagaggaggaggatttagaaggagggttttgt

SEQ ID NO: 414 - DNA, 3000 bp, Arabidopsis thaliana
gtactcataggtaaaattctttaatcttctgttttgggaaaaagactttgatatgtggttataataactaaccagtattttaatagattcgatttgatttatgatgctcttcgcaccatcaaaagatataaaattctactttggcaaagttatgttatgctctgttgtttcgttaatcatcccgctcaagttttaacagattacaaaatccatctcaggtgcatccgctgcggtcgtaggattaatagctgcgagcatattttggtatgtataccatcgtagaaaaacaaaaagttacagaaattcttcagcattgcttccaagaaacatctcatcagatccatctgcaaagtcttttgacatcgagaaagcagaggaattattagtcggagttcatattttctcttacgaagaacttgaagaagccactaataacttcgacccatctaaagaactcggtgatggaggctttggtactgtctattacggtaagcttaaagatggacgaagcgtagccgttaaacggttatacgataacaacttcaaaagagcagagcaattcaggaatgaagttgagatcttaacgggtttacgccatccaaacctcgtggctctctttggatgctcctcaaaacagagccgggacttactgctagtgtatgagtatgttgcaaacggcacgttagctgatcatctacatggtccacaggcaaaccctagctcacttccttggtctattcggctcaaaatcgctgttgaaactgcctctgccttgaagtatctccacgcctccaagatcatccaccgtgatgttaaatccaacaacatccttctcgaccaaaacttcaatgtcaaggtcagtaactcacactggttattactcaatctggtgggattttatcggatcataatcttaacttctttctgtgttttttttactgttttcgacattttaggttgcggattttggactctctagactgtttcctatggataaaacgcacgtatctaccgctccacaaggaactccgggatatgtcgacccggattaccacttatgctatcaactctcaaacaaaagcgacgtgtacagctttgcggtagtgttaatggagcttatctcttcacttccagcagtcgacatcacaagaccgcgccaagagatcaacctctcgaacatggcagtcgttaaaatccagaaccacgagctccgcgacatggtggatccgtcacttgggtttgacacggatacaagagtgagacagacggtgatcgctgtcgctgagctggcgttccaatgcttgcagtcggataaagatcttaggccatgtatgtcgcacgtgcaggatacgttgacgaggatacagaacaatggatttggttcggaaatggatgttgtagatgtgaacaagagtggaccgttggttgcacagtctccagatagtgtcattgtgaaatgggacagtaagtaaaattagtcgcacggccactaacattgtatgtgtttattatttgtatgtttaaaattgtcagttaacagttagagaatggtgttcgtgttctgtattagatgatatttttgggaatgtatataatgatgatcttgttccgattccacctagagagggaccgtaacatacaaaacttcgtgattgggcctgaccggactaaatcagcaattttgtattgctatttgctgccaactgaaactatttttttattagtggttaattttatttttttacggaaaaggtaaaaatatttgagacatcaaaataatgatggtaattaagtaacgccagctcagcgacggcgatgactatccaccaatttaacgtcagaagaatatatatatgtatattgagcttatcttctgtttccaatgtaagtggaaagtccactgctgcaatcacaatgtaagacctgcatctatgaagttttaatgaaagacactttcagagaaaaaaaaaaaaaacttctgtttccaaaatttcctaattaaagcacaccaatttgggcatggatgctttactacttctattaatgaacaagttaaagagtaagttgtcttgaatgaatgaaattgcatgtgaatcaaatccctccaccatacataatagataatctatagtaatggcccaactaaacattgacatttgttgcaacctaactctttcctaaaaggaagaaaaaaaaaaaaaaaaaaaaactctttcctaaaactcaatgtgtttgatcatcacaaggacaaacaaaggaaatctctagtatgccgattaaagtgaaaatttgtcttcaccaatataaataatttggtaacttaaactttaactaaagattcataaattggcgtcaacttatgtaaaagaaccttcatatatactttcgtttatctccctatatttttatacatacacatatttatagtatttttgtcgattaattggcattggccatttggaagttataattaagttggcaaatggatgtgatctcttaccctatacacctacataaaaaaccctccatgcaaaacattaatggatgttttcattaaaacaagttttgatatcaacttagtttgactagctacatccatttcaatattttcttcccaatattaataataaatttaaagatagaccactagttcttaacctcacaccaaactgactagaaatgttcttcccccttgcaaacagagaaagcctaatggaacccacgaccaaacattggtcctacttttccttgtttggacatatctccccgacacacaaatcccagaacgttcacttgcccacgtggctctccctttatttctctctttttctttcttaattttctccacatttctttttctaaaatcataaattaaattaataaaaaaatccaatcgaacaatataaaagtctcaagttttgtatcaaccagtctaaagaagttgtcagaaaaaaaaaaaaaaaaaagtgtcaagaagatcatatctcaattcattatatt

SEQ ID NO: 415 - DNA, 3000 bp, Arabidopsis thaliana
ctaaaatattttttttaactaactaaatgtttctcttcataaacttataacataaatttaaaaatgtattaaattagtaattgaatttgtatttactaaattatttttataattattaaattaacttatggtaactaatataacgatattgaatagttggatatttagaaaaagaagatgaggggaaaataattcttatactattttctcataacattgtttaagtaatattaaggaagactatctttatagtacatatgttattgtttttgaaacattggactgataaaatcattattttttttctttagccatatatatttgattaattgatctatttttagaaggagatccaattatctgaaaatactattgtaacatgtttcttctttattattgttgaatcattgacattctttttgttttcaaactaactttgcactaattcttgtaacaatctctatgtttgatcaattataacttcggcgatccttgaaaaaaatatctaaattatttagctaggagcctaggactatatattatttttgcctactatagtactacttggatggttttgaaattatggtatctttttatgtcgcaaataaaaactagaggtacacggacttaaaggagacaagagtatcatagccttagatttattttccaccgtgtttctaaatagtgggattctttcgagtttcgatcaaatgatttttcgcttagatttcgttttgcatcacatatttaagttgttgcttccctctattggttaaagcgaccaaacaactttgttacacagcaaccctaagtcgtgtcatagccatctaattctcacatcttctataccgcataaaagttcgataattattaattagactaatggaaagatgccacctagttaatatacaaattaagttgggatatcgtctcttattcttacatatgtcaacatcaagaatactttgttttaagcatgacatgattacattaataaagcattaccccacacgccgaaatgttattcttatttttatccgtgaattttttctatgatcaaatttgtccgtctaagtggattgaatgcaaatgtgagtgtttaattcccatcatcagttggaagatcagggattctttttgtacaagattggaagatcaggtttttgagttgaatatggtttgatcatcatcattttacgaacattcgaaacttgcatagtcgagtaatttttatctctcaatttctgtttcttaatcaatatccacgtaagttttttttttttttttttttaaacagttgtttttaagtatcaaagacatgggaaccagacagttgaaaatatatttttaagacaaatttacatattttaaatgtcttctaatcttaatattttaaatgttttctaatattatcttgttttaaaaaaagaacacatattttcaaattatatgatattgttgttactattatttctttttttactataaattttgtgacaatatatatatatatatatatatatattaaccatttttcggcggtataaaatagtttaccaccgagtaattgcattcaatcgcacgaccaacaagttatagtattattcactttgccccaaactaaaagtttattttagaaaattcattaacagtaaatttcatttccttcaaaatacatttttgttctgtttttatttatttatttaatatattaacatttatcatgtatgatgattgatgaagatgattttctcaacatttctctccttttttttttgtctctcaacatttctctcctatataaaatttaaactattgaacgaatgttactgctacgaaattataatatttactctaagttgtcatcaggattctattactttaaaagccaaaatttactaatcaaaaactagttgatagattgtaaaattaattaagcacatttattgatttaaaatttattttttactctacaaatcgtgatttccaagagttgtatctatataaaggcaatatgctttcggacccatgcatggtcttgatgtttttttacggttattccattacgggtagggttatgtgataaacgatatgatttcatataaaaagaataaatcagcggtcattgtctccgcatggttcggggaaaaaatactcgtataaataagcctttagatttcgaatttataaagctttgacgtcggctgatacatagaaacaaaaaaaaactttgatgtcaagctctctttcctcttcctgtccatcaatacgcgttacacacgcacaatagaagcaaattattgtttgaatacctaaaagaggatagacgacataattatcaccgcaaacactctaaattttgggatatagctttcattagattacattttgactcacatggtatacggcaaaaaaatattaaattcatggcaacgtataaagttgatatttcaacatgttataatttctctctcttcgaacatgagtgtaacaagacgaaccccaaagcctgcaaaaacacacagaatcttttctttggttttgtggaccggtctacaatctcacgtgcaaaaccaaacatacacgatctctctctctctatatctctactttttctgaactcagttggtttcgattttcttcggaccttctattgttaaatcagctttataacctcacaagcttctcctctattccatagatcaaaccacaactttgtttgacctttttttgagtacttctcttgtcttttcttcttcaagtttacttagttctttgagaacaaatttctgttgattttttttctttcttgtagagggataattacaagtttaatttccctagagtgtctttaccttttgccttgtctccctctcgagacaaaaagagaaagagaaacactttctgtcctctttttttttcctctctttttctctctcgctggaaaccttttcatattcaagtgtaattttaatatttcaagcaattttctagctaatt

SEQ ID NO: 416 - DNA, 3000 bp, Arabidopsis thaliana
cacacacacacacctaactatactttcggctctaacatagacatgaaacttgcatttaacatagttatatcaagacaaagctaaatgctcaattcattcctatgtggagaataataaaaaattgagctgtgtattgttgtggaacatgagagtctggaaatgtctccatatttccactcattgaataaaaatatgcaagatccgttctgatctattgtgttcactgataatatctaatcgtctaacagagcaagaagagaaaatgagaatgatccatgaaaagttcaaggacgatgtcagccatcatcttgaagattttaagagtactatcgaagagcttgaagcaaaccagtcagagctgaaaggaagcataaagaagcaaagtatgttaacttctgtaattcctgcttttactacaacgaattctaacactagaaatacttgaaacatatgatgttatcaaagttagattcttcatggcaagatagttttaatataataatagcaggaggacaagtatttcctaaactcacttgataactttttatctctctatgacaggaacatcacaccaaaaactcattgcacattttgaaggaggcatcgagacaaaactggacgatgcgaccaaaagaatcgattctgtaaacaaggcaagtcattgttctgcttcttaagagtcagattctaaaaatggttaaatcatgaattcaaaagcacaacttaaaaatgacgtattggtttacagtctgcgagaggaaagatgctgcagctgaagatgattgtcgcagaatgtttgagggatgattgacactgagtctcacagaatcaatcaaccacacgtacgtcgttattctccattttaaaacataaactagacgaactgtgttaaccaggaaagaaaaacctctcaagcaaaaccagcctttggtttagtggtctcatgagttcaggcgaataaagaagatatagtagatgatgctttgactcattgtcattgattcgtattcgtatagaatagtttattgttcactgaaccactacaaaactacttatatcatagagccttattttatatagcagtttgaaggtttctttttaatttatttttgccagcaactgcagatattttttattaaaccaacaacttttaattaggttattgatatcttgatatatatcgaagcaaaaccaatccaaacatttttcttttaaaaaccagaatattttgcagacgttgatgtgaattttaattacaatattttactttaacagagatgtatttcatattgaatatcaaaaccaaactgaacaaagaatggtcacaattcgatatcaatcgaatgaaacagaaaataaaatgttggacccaacaattttactgtgatgataaaaacatggtagagataattttgtttgtaaatagagagatctcaaatcacagaggattctttttttacggtcggtaaaagaatttagaatgtgtcgagagggtaaaaatggagaagacgacaagatagtagcagtcgttagaaacaaacaagaaagaagggagggagacaaaataacacaaaggggtggatgaatcacgcggcattcacgtgaagtgcacgtgaacttggccaaaaaaagcctaattgtgggtcccatttaaagagaaaactaaagcctttaagaaagggcccatccatatatgtcttaataatggcgtgaaggttctttccgctcacgtgggccttttgtgcccgtctctctcgcatgtcactcactacagttttactagtgttttgttttatttttgataacaacattattgattttttttcggtctacctaagttttgacctttcttttttaattgtgaacaattgaacatgcgtattacttattgataatacttttatcttcaataaaaaaaataacacacgaacataatatagaaatagtgtgttccaatactggagattatttagtaagttcagttggacgctttgtcattgcatagtttggaatttattcctaaactttctaagaacacgttcttataggaatttgcatgacgaaaaaatcaatactagttgcattattgttggagcatcatcgggagtgattttttttgtgttttcctatttactacattgtgttttcctgaccttttaaataaaaaggaaatacacaaaaccatatataaatatatgtatatatatatctgactgtgctcaagtaaaattcacggatcagacgttaaaaaaatgatcatgcttaatattttctcattttagatgaagacaaaaaaaaaaaaaaggaattgcaatcgtagatttgactttatttttatttaatttttctattctttttccgaaagcagagaaaaatggagcggtggagagtagagaagtcggtcataagaatgtctctctctctatttctttgtctttcactatcgcccatacattatcttgcttctttcatttattccatcaatatttttgttttaaaatgaaagatttacacattaacatgaatacttatactactctttatcgcgtatatatagtatagtctatgttattatgaatttatgattatattttttctataaaacgtgcgaaaactcatttcacatatacaaacaaatatatacgttttgtattaaaaaaaagcaactgtaaattttataaatctgaaatgtaacatttgaagtcgaccaaagtttgtaaggtaataatttgtactaattctccatactgtgtcataatcacgattcaaggataaatatatgagttgtggaccaaaacaaatcctccatatcaatcaatcataaatgaaataagcgaatatacatatatacaaccgactatatatatatatatatgctgctcttcattaaccccaagaaagaaaaccaaagtgtgaagtccgaatctctctgattctacaattcacaaaaaccggaaaaaaaaaaagacaagtaaagaaagctttgttcagtttacttca

SEQ ID NO: 417 - DNA, 3000 bp, Arabidopsis thaliana
ttgacatatattggcatgtaaaagccaggaataagaggcttgtggggcaatggcaatgctataacctgcaattcaacaacataaagctcaatgaaaacaatcgtagcgaagctcgaggaaatggttttgctataaaaggttctagcttttgcctgactataaaactaggaatgatccatccaaatttgcgtatatcaaaagatcagtatactataaacacactcaatttcttcaaaatttcgaattttccaaccaatgctattaaagtttatagttttaactttccaatcgctagaaccataaagaaaattttgccaattgagctgatttctctatgttctatgaaaaatcaaagcatatgaagtgcaccagccaagttcaattgtttctggaaatcttacattccccatgatcataaaattccccatagtcgggaaaaaaaaaagtgtgatcttgaaaaaatttgaacaaaccgttagacaatcgtccaggtgaggtttagctgagacagtagtagttgaagactttgtgtcggaatccaagtcggaggaaaaagaacgacgacccaattcgtaggaactccggttccatccggttagaagagtcagttgcttgaacaatagattcttaaccggggtagaccggaatcgagtagccggagtcacgtgatgggaagcgtaagcagtcggagtgagaaacttcagcatgacgggggaggaagatcttgagtagcgaatttgggaaattagggttaagcttagcctaataggcaagaaaccgtacgaaagtgaagaatgttgtagacgaagactggtggtgtcaaaagcccttcataaaccccttcccaagaattaataaacaaaaaaaaaaaaaaaggaagaaaacgtatttttgggaaaaggacatccactgcctccaacgatgtcgtttcattgcatttatatcttattactagtcttaaaccaaaccaggaccggtttgaaaaaaaatcggtcgttagctaaattttgggccgaagtaataaactttatcttggtcctgggcttttattgttttcattttcaggagcccttacggtaccaattggtactatctttcttctttggaattttcgaggaatttgtttatggttaaagtgaaactgaaccggtttgatgatacaacaaattaagcagatgtattttttttatgtcaaaaaataaaaaagaattgtttctttctgctaatcagtataactgttgacaaaatgaaatactaaaaacgtgaaaattgaaaggaaaaaaaaaagagaggatgttgtgtatataacttaattagtactctaattattccatattgttgttctttgtttcgcatgcaatgtacggctccgtttaataattcataagtttgatttctaacatatatcgatgtttttgacagaatattcagaaagatttgtctataaccaaaaaaaaaaaaaagatagaaaaaatttaagtgcacacatacctaatattttgttcatgaaacaaatcattgtcatcattattaatattattgtcctgaattgggataaccaaaaaataatcaatgaggataacaactaatcatttgatttgggaataataaataaacaaacagaaaaggaagaaaaaattaagaagaggatatcaaagcgtgtctgacgccaggaggcaaatctctctgtcatgactcacgtttattgcttgaaaccccacatttgcattgtttttctttgctaattggatacttttgtttcttaatttctttgctaatactttgtctttttttttcgtatgttcttacttcttactagcctaaacaaatacgaaacatatgcgtttcccaacccttaagtaacttttgacggatagatgttagattagttataatccttgacatggtataaaaatatttaaggaaaacttataatgttatttagtatgtatatatagaacttgcctttccacttataaactgattgactagtgcaatccaaaacccaattctatgcttttcgaaaaaaatcaactaaatcaaattattattttctaaaaaaaaggaagaaaagtataaagaacatgttatatgtttcacaaaacaccaaatactgaaaatcttttttcgaaaaaatagagagattttgagccaaaaaatgtggatgataaatagccacaacaaccactaagcctaaggtgtgaaggtcgtgaaataaaacaccatcacatgcatcttctctttttcctattcttttccttttttttttgttccttctttaaaaaaaaaactcattagctttttttgtttctttatgttaaattttgtttgatagctatttgttcgatctattggttatattgccaccaatcattgccctccacattattacatcaaactcctccattccatcgccaattttgttcttttcacaactaaaaatctacaaactaaatattccacgtcataacacaaatttacgccgctcaccatcataaatagatatgtaaaaagtttcaagtttagtctatgagtaaaatatctgttcaaatatctaattttgcaacgaagatagatattttcgttcgacgtcgaaagaagaaaagatattttttgttcctgaatcatttttctaatctaaaaatgcattaagttcaaactgaatttttttcattcaccagttcaatcataattggccaatgtgattttagacgtacattattattaaagaaaaataaataaaaaataatggtattcaattcgaaaaacccaagaaaatatagaaaataattgatttaagggtggcttctccaatctctcccaaatgtttatatatagagaattagatatcccctccaattactcaaaattattatcaaaataagaaagagctcaacattgttctctgactctataaataactgttcttggaaattttccaagagaacaagaaacaaaaacaaaacgttgtttaagtgtggttctatagatttcttgtga

SEQ ID NO: 418 - DNA, 3000 bp, Arabidopsis thaliana
gctggtagcattcgtttattaaaaaaaaaaaagagttggtagtattctgctgatttatatataagaaaaaccaacgaaaatttacaaaataagaatttataattgtaagacaagactataatatattaaactcattaagttgcacatattagtgctcgtataagaatctgtttacaaacaaaaaaatgaagcatatatgaaacagctattaaagtatatacaaaattaagcaaacaaactatatagtattataaagatttttgtagcttcaatctgctttaatcttaatttgtaggataaaaatatgagtttcttattatgaacagctaagtattttccatctttttaaaggtcaatatttggatattataaaactgatactatattttatcaaaatgtatagtacagtgagttacgttgtactagcaacgcaagtgaaagttttattgaaattccaatataatacatttgtgaattttttatataaaaaaatgcttgcggttagttagcattttggtttcacaaaactaaaatatcttaaaagttttatttttttgggcgacatatacaacgatatgttcatgatgatgaacttttacaaaacaaacctaactgaaaaagcataaaattattgccagacaatatattattaaagtctcattaataatttcaaaacaaattcggttaagtgaactttttatgaaaagaaaacaaatactatgtattaaacatatacaacaagaaaacattaaacatgcaagatcctacggggaaaaccgttagaaatggattttcgagatttttgacggaattcgaccgtcgaatatacaacattggaaatcaaaatctgttggaaatgttttggaattttccgataattgtttttaattattttaaaatattatgaaattaaattcaaattcgatttataaataagaatcttgtatttatacaactcggaagctctagttatcgttattattttcttttctctcaacctattagaaactatcactaggatcatcaaaatcaaagatttatcgagtaaatctcccaaaaacgaatcgactagattttctgtttccgatcaaaactattgttttaagactttaagtagtcccatactaaaaaaaaaaaaaaaaaaaaaaaagtagtcccttactacatcaaattcgtcttccttgacggcagttctactgtttacctttctaacaatttgattagaaaatactgttagattattataagtggttggtttgtaactgaacacggcttacacacagaacaaaaatcaaacttgaggttataatgaataactacataaactcacatgtggcataatgcatgctcgaaataatttgggagagtgggatccatgagatgctaatgaggctgggatattttaggacaaatgaaacagctggtttccatctattaataaccaggatctttcttgtctcctcttccaccttgtcttgaagttgcatgagctgtcctaggcctatcttttaactatgtccactccacttcactcatcctatccacttagcttatccccattattaaatgtgtctcccttggttttactatttatctttatcatattttgattgaaaaatatcgtgaggttagtttctagaagttttacccgatgacaatcgaaattgccaaaacaacaaaagaaactgataagatattttctctgtccaagtgaatgagagtgaattcccaatatttttaaatgatgtttgtattcttgttctcttttttttttcatttaactgttatgggatatgtacgtaattttccgcaattctaatgtatactataacaatatgattttcatgcttagactgcgttagaaagttcggttataatactgacaacatttgtgtgttcattgatactgcgaacatcttcacaaacatattgataaataatctcttctcttgcatgagattatattatttgagtacatgtacacgttcttatttgccgaatgttctttgttgccaccataaagttttattgggccaaaactaatagaaaccacacataatcatttcgttgttttgtgtttttgtcaaacaaatcacacataattcaacgacaaactttctaatttgagcaacctctttatctccttgaaagtttctatggagaattctaccgattagtcgactcatgactattcatccattatcacaattgacaaatccagatattttgatcaaatatcatttgatttttttgttctatctcgaagcagataccagtgtaccataagaaaaaaatgcttcattagtcatcttcaaatcacatgcaaaaatttggaagaaaactgaaaacaatttgcatgatagatcataatgttcaagcaaaaataaataaatccaaatgtgataaaatgtatagatattcacattgatcttactagtaatattatatattttctaaagttaattaaaatgttctatgtatttttttatatatgaaacacatcatataaaagaaaattggaatgtaaattccagatcttgatccatataaatatatcaagatttatatcgatcaagatcatattgggatccgttttagactaatcaagattttaccattcatatttcttggatatctgaaattataaagcgcgtcagaaaatcttctacaagacactcccaacattaaaaagccagagaaatgatttgcacacactcgctagttatatacatacaaagcataaagttctgtcacgtgtaaaagagcttgtgaaacattacagcaaaccaaactatttgactaaagatgaaaacaacacctctcccgaggctgcattatttagtaagtcttctttgtttttttctttcttccaagattaaagaagacagacccaattatgtaagggcagtctctcctataaacctaactagttcattggaaaaaacaagagagaaaaaaaaacgattactgctgagatctaccatttctaaacctcaaccc

SEQ ID NO: 419 - DNA, 3000 bp, Arabidopsis thaliana
cgtgaaggaggagcattgggccaattgggcatatggcttcattattatttattcatttgggttaagttgggcctagcctgaaaatagaaataaaatttggtgaattcatatgggccgaaaaagctgagaacaagcccaaagatggtgatggggaaatcatttttgagctggaagaaaggcaaaaaaagtaatagaggtttcgtgagcaacatgattcaacggtagaagaggtaatgtatattggctatgggaaatgctgttgctggatttttgtatacagttaacttacttggtcacgggctcgaagggagctgagctagtcgcgtacgttggttggttggttgagccgtgcacctaaagcagctttgtaccgacgcgacaccacgtggcggacatgcttttgcgtggacattggacctttgtctctctggggtccctccgatgggtcaaactagcaaaagtcaaaccgtcgaatattcgttcacactgtcacatccaaaatcagacaaaatggtaaattacatcaaaactctttttctatataaacaaaaaaatattgtcgacggttggatttacatattttttaataaaaaaaaagaaggaaaaagagtatgccatgttctcccgtcgattatataggaactacttgttcgtttcttcaaaaattattgggaattaataactctgtatataactagatttatttctaaattaatactctttctctttctcaatatttgtagtttaaggtttttgcatacaaattaagaaaacatataaatttcatttaatttattttttttctacaaaaacattattaattataactaattcaaccaataaaaaaatataatataaaatataattggttaaaatctattaaatacatttaatgtttgcatagaaaaatcaaaacaacatttatattgaaaaaataaaaaaccctttaaattacatttaattagaaacagagggagtagtttttatgccactaaattctgtatatcaatcgttactatcggatccaaatatccttcattttgtttggttgacaaatttcttttcataaaatacaacatcaaattgttttaagttatttagtatcgtaataaaatcttaaattttttcacattttacctaaaaaaaataaaaaatcataacaacgtatttctcaatttacaattgctactcaaagatgttctctttcttttatcaccgcatgtccacatctccatcataatcttccattgttttcaaagctaacagaatttgtttaagagtaaaaacacatttaaaaacattaaaaaatgctaagatggagatgcggggtatcgatccccgtacctctcgcatgctaagcgagcgctctaccatctgagctacatcccctacttgcattgttaaataaagttaccgtatatattattttattcgggtttggaaactttttctatctcaactcaagtttccataatttgaatttcatgaatagcaatcaaattcggcgatttgtgagaggataaaatccgaccaaaaaatctcgatcatcaaaatttgacagttaagttagaaaggcaaataaactttacaatggtaaaaaaaaaagcaatacaaggcgaagaaaagctcaacaatgaggcattattgttgtccttagagaaattatagtgaataataagtgtaaagtgtttttaactcgtgagcataattcaaatccatacataaggcagcagcatctgtaagattattgaagttgcgttagtcaattttcttaaaagatatatgtaggactaaccatcgagtcaatgacaatctttgtcggtctcctctctggatttaataatatgttaattcttatcgaagaagacctcaaaacttgtggacgatatacgagtatagaacgggcccagtcccctaatgaattaagttttgtattttattcaaatttcaacgaaccatcacacacatgttgtggttttcatcaaagtgtaataatcaacgatagtatcccatgcatgatacacgaaaaagaaaaataatctgaatgaatgaaccaacgtacgtagggtttagctggaaagatgctcttaatactcacggacattgtctcattccatcatgcaaataatacttctttttcttttcacatatgcaaataatactaattatgtagaaaaaatcatattttgtttattttattttagtagctacaaattcatttaaataattttaaatcttatagaaaaggatatttgaataaagcctatactaatccgaattttcaagacactggtttttgcattaacgttacgagcttaacgttaagtgagccgcaccgagccaagcctaagtcctctagctggagctttaacatggaggactacaatacaatgttaacgtcagatccaacggctgagagcgattgaacacgcttctgtgatgtgaagggcttaatcttttctatgctgacttcatcatcatatcttctttttttgtagtaccaaaaaggctaaaacgaaaacgatttagagaaatgacaacaataataaaaagtggggataatttttgatttctgatagaaagaaagagaaacaaagaaaggcgggaccgatccgccattaatgctaccacccaactacaaggcttttctcacacactctcttctctcaatctcttggctcagaacaaagaagataaaaaaaaaaggtgagtaagaatttgtctttaattatttcttcatgtgttagttgttaggttacttaaatcggcaaaagagatttgatgaacttggtcatatgctttaaagtgtgcatacatttttggggttgttactagttgtcaaatcttttcctttaaaccaatttgatttccttctcatcttttccagcttccattgattaaaagtttctacctttttcttatcttcaagtgtgatatattgtgagaagattgcagaagcgtgtccaacttggttccctctctctctgaaattactcaatc

SEQ ID NO: 420 - DNA, 3000 bp, Arabidopsis thaliana
tctttgttgatttactctaatctgtgaaattaactaactataaaaaccagcatcatgttttaatctactaataaagaccattcaacatattaataaaatataatccgatggtgacgactgatgatcataatactagtagtaatggatcaatcaagaatcctctttaggttagaaaaatagactaataaccaattatagagttatatttaagctcaacaaaacccacaatagtacattctcgttggtttcttcttaatattatattgttgcttgttttgtaccaacaaaaaaagtacgaaccacacactttcgatcgtgattaggcttctttcaacaaattttgattagtaatataattaaactatcatcgtctacataacatatgttatccgtttcactcaacctatctatgttatctctttgcgaatctggcgcgggtacttcaactagtgtagaaagatactattcaaaaaaaaaaaaaaaatctaagatcacgagattaaacatgatatatatatgatgtttaacaataacaaagcggtttgttcaaaaaaataaagcggtgccggtatgctagagaggaaagccttgataattacgaccacaagttgtatgagaaaaattattggaaccttttgtatttcatgaccctgagaaaaattgaaaatttgacttaacgtggagtttgctagagaaaatgactcaacaaaattatatccctagctttgttttacgtcaaattgttactctcttttcagttggttcgctagtttgatttccggtattaagttactaaaagcacataatgatatttcagttggttcttggtaataagtttacacgagacttttgtggtattaaagtacataatgatcttttaattagatattattaaagcaaaggtgaaaaaagtggttcgtttactgtttttacaatgtgacgactgacaagaaacatggacgtgttaggttggatagatagctagatactatcacggggcattgtttgattctttctggcgaataatatacacttattttgttctttttatatataccaattgaatcctataatcaatataatattagtccactaaccacgagcactttttgcagattgactttccaacgatttataatagtaatatcttcataaagaaattcattagcattctacaattttcttcataaactggaagtgacaacaatcggacataaaaatgattcaacttttccatgacaatttttgtttctttggtgaagaaattaatcttttctaaataaactttttttattgaccaaaaacaatgtatcttttaaaagattgcacggattctatggttgaatatattctagatttagtttgtaatagcatatcgtcaactagacataagtctatattcctcactagctcgtgttcctttcttctttcgtcacggttagttcagatccggacaagaatcctggattgacaaaattttggaaatggcttaattaaactattgttttatctttcttacaattctttgaaacggtgatatttcatataaaattctcaaaatttttaaattagtgtcgttaaattctgtattagcagctcaaccagttaaatataaagccacgttttgagagaatcggattatatctgaaattcgataccagttacgaagattatattacatttgattttgaagttgtaagataaaaaaaattagtgtcattattgtatgaacttcgtgaagtttatttatgtgcttcacttttagttaataatgtaatatgtataacaaaaacaaacttgtatgcctatatttagtacaggtggattgaatcgtatcaatgtcacgtaaaagttttatttggtttaatgtctcacgtaaaagttgcttttacttttcaggtgcctagccgtgttcagaaatcagagaccaaaatcttatgggggcaatatgatcaaatgtaatataccaacagttagttaatgcggattgttgacaaagaagaacatttcatgatcggatattgttgacaaaaaactactgtaagccaaaaatgaacaaaagaaattaatgataattaagtataagacttgacaaaaccaagccgacatgagctgagtcaagttcatgtcgtcaatgttatagtgatgattgacgaatatccaacggctgagaatgattggaccgcagtggaatggacttttaactataaaatgggacgaattattcatgattgcttaattgaaaattcacattgttattttgttatttatttatcattaaaactctacttcttttctcttttagtcagttttgataaaattcaaaatttcgtttgttacaatttgaatagtattttaaaatcaataacatcttttttttgtcattctaaataattaaaactcaaaataataatttttaaaaaatattgtttatatatgtgatataatgtggtaaaatacgaatcaatatattttcgtataataaatttatattccttataaattatcgtcaaacttcatattaccaatgtttatttttgggttaaaatctcacactattttttttttatacttcaaaactcatatattttttgaacaatcatgcctccaatatagaaaaaacaaaattgacggatacaaagaaaaaaaaacaaatttgacattgaatataaatgcaaatatttttttgaaaaagtagaaaaaataaaaagaagatggggtttaaaggcgggaccggtccgtcatcaatgccacctccctaactcctttctctttctctctttcagctacttgcaacaaaattgcaaaattgtcgacagaaacttctctcaaatttagttcctttctcatttatccactgctcttaatccaacttcaatatctctctatcctcacaatatttgttctgtttctccttcaactttcaactgataaagtttaaacctttatgctctttactctctgatctcaaaagggttttgtttagttctcctcaaaacc

SEQ ID NO: 421 - DNA, 3000 bp, Arabidopsis thaliana
atgaaaattacctcattttccttcctcacaatagagattatgagctggaactcctattccactaatataagctcttcacgatagatgcttatggaacattgtcgtcgtgaaagaaaaagaaagaaaaaagaagaaggtgatttaagacgacaaaaacgacgtcgttttacaaaaatttgtttgtctcttctttcatctaaaacgacgtcgtgtcatacgtggcatccacgtgagcaaccgttaacggtttcgtaacaccgtcacggcttaggcatgtattgacatgaatggtgtgagtttgggatttgaatttgaaaatttggtttgttaatgtatggatttgcacaacaacaaacgttgggtatgaattgaacatactactttagctggggtatgaaatgaccgtttttcctagcataattagtcctaaagatgaagataagataaaattgttagtattaatgaatagtcataactgataaataattgtatgcgataacaatttgctaacaattaattgtagttgaacacaagtaaactgacataagtataaattcgtttttttgttttaacattttacttgcaaaaaaaattatttatggtaacaatttgaactatgatacgtccttagctgccagtcggttgagcaattttttttttttttttaatatcaggaggttctgaggcgaaacctgtaatttccctaaacccaaaactaaagtatgtaatattaatttcatctcaggcgtcgcagtcggttaaacaattgatacgtcagtatttgattttgaggtggcagctttcatgcatctaagagcaacctcatcaatggtttctaaacttaagtttcttattttaaagagataaattttattataaaaaaatgtgtgagtttcttgattaacaagaaaccatctccaaaataccttatataaaaaaattttaagagaatttctaaaatatttaagaaacacacataattaaataatattatttttgttgtttcaatgttaagaaacttatatttagaaaccaccaatgaaattcctataaagatgcaatccctaaaatcttgatagatgtaatgttactcgatagttcccgtcatgtcaaaaatattggtggttcgtaactaaaaccacctgacatatatcttatcgtttgacttatcataggcatgaaaacattagaaaaaactcttggaaattataagttctcttatccattattgtctatgccacacatattaaatactcttaagagtttttgatgtgcggatcatttgattgattgaccaagaaacttaacacaacaagtttaaagagttcccgacctctatccggtacgtcgcatgagggtctctccccacaaaattcactatcaagcatggcccatgcttgcatgagggcttgaacatgcgacatagaaactagactgatcgcgtgactagcccccttatggtatgtaaaccatcactaaagtagtgtggtaggtaaatttcgatatatttttccttagttcatgcatctaaaacatttgaaacaattatttttacatcgtgaaatcaaaacgtagttattgtagaaatcggtacacattaattttaagtaagagaaaaagtcgaccaaattagcaaattctattaattattatcgttcaaaaccgcttcaaattcaaaaagttccatatgatgttacgtcattgtgtgggacaatgcaaatgtcaacaactcagagtgaacaagtcgccttcttcgccaacgcgctcacataatttgtgtaatattttatcttagtgtttctagaagcttgactcgctcgcatattgcaattctaccaaatcatatttttattttaatgaaatttctatgattttgacaactaattcttgattttgaccttactatatttcttgtagaattagatagggtgcaattctcatagaatgtttctttaaatttatttctaactaatattaaaaaaaactataatatattcggatttagtcttaagaagatttaccgttacttctaatgatatatttgaatatttgatggcaaatcgaattcaaataaccaacaagttgttggtccaataataaattttttagataaaggtattgagttttagacacgttgggagagatttcttcgtcaaataaaatgaatttattctagtgtgggtctcgcatgtaggaaatgtaggtcttttaattttgaatttccaaatattcaaaaaaaaaaaaaaaaaaatcgaattcaaataactgaaaattagtgtaaattatataatagactatctattagtttctttgaaaaacatatagtatagtaatagacattttgataaatcttcatcttttacatttctaagtatccaaatgcttttccaaaccatatgttttcgggcttttttttttttatcaattcggtaagaaacacattgacggcattaattaacataaaactaataaactacatgttttctatgtttttttgctaatttttcctaaagctaatccattagaaaattttactattctaactatcattgtatgaaaaaggtattatctaattgtattcacaattctataggaaaaaaggttaacatgtcattttcttctcctttttagccgtccactcacgactaagaacttattcgtctaaacatgaattacatgacaatgtcaaagcgtggttaaaacttcagaaagaagtataaacctacctcaagaagtcgtcgtcctctttctctaattaaactattatttcccataatagaaaacactaattttttgcctttttggtaaggaaagtaacatagttgttagtaaatatgaattaggaaataatatacaaagtcttggtcctcttctcatcgactttaaaatctctttctcccattacaaaccaaaaccattagaagatttcgaaaaagaaaaaaaaacacctccacaaacaaaacaatggcggtgaagaagaaatcatcttggagatcattg

SEQ ID NO: 422 - DNA, 3000 bp, Arabidopsis thaliana
ctatattccaccatttccactgagttttctttggttttcagttaatcagtttgtatctgtatgaaatggcttttgtataatttaattgttggacgttttccaggtaccgaagccaagccaaggaacaagggagttgcttcatcagcttaaacttgtttttgagcatcaagggagagagaattctgagtttgttgttcacaagattactactcttaagtgtctgattatgactatctttttgtgtggtctttgcgtttttaaagttttggacatggatggatttcaatttgcaagtcttttaattctctttattctaatcattatggttccttgccagtggtgtgtccgtccgacagataaagacttggtaaagtcattatactctacggcccacttatatcgaatacgtattcttaggttcactaacattcataattaaggtgagttgcttgcaaatttgctcataggaattatggtgtttctatatgtataatatgatactatgtcttgcagccaaaattttgagacgagtgtcgaaattatatgtctaagattaacataatatcaaacagaaaatctttgaaatcattataaacttgaagttagagctgagaagtcggactcgtagacttaaattgtggagatgggcttatgaacgaagaaaatggacttgtgaactgaaaatatgggcttttgatcttaaaaggtaaggagatgagcttatgagttgaagacttgaagagatgggtttctcgtatctaggtttttctacacttcagtgtcctcgtccacgatgataattgggtcaccttgacggattgcgattgtggtcttactgtcttagtctgcatgaatgctttgattttatgaatttccatggacaccaacaatgtttttcatgcaatttgcttaatcaaggataatatgctaagagttctataatatgtatctttgtgaccaattaaaaatgtggtatgtatttggttgaacctaagtgatcgttacaaaacatcgaaaacatttattttctttaaaacctaaaatacatttgatctagtgatagcgaagcgaattgtagaataagcggattaaataatagggtgtgattagttttgaacaagcgaagtagaataatgtataaaaggtaagagtagttttgaaaatggatattctaaaaatgaaatttctcaaatattctacaaaaacttatgtaaaaaatgtttttttaacactggatgacaattctttgaaccacaccacacctaattttttttttcttcctcgttttgaacgtaacaaaaattattttgcataactcaacctataaagaaccaacaaaaacaaccattgtgtgaaacccaagaaaaaaaaaaatgcatttctttgttgactcttggttatcacaaaatggttcgtgttgtttgctgttttgcaatttactattgagctgtgacttgaaatttgatatggtttaattcgaagttgttttggtttctattcgtaccaaagacaaatacgattatttttcccaattaaccttatcattaaaatgatcttgagattgcattgccaaatctatataaatttttttgatgcataacaaagcaatggatttccattattagtaatccttgattcacagattttgtcttgaaaacattgttggatgagatttcgttttgtgtttttccttgtgaaaacgtaattgttttcggttattatatttcttctgtcaaatatatatggttcctgataattgcttccattgattacctacttgtcgtccgtaccctaccacattaattgtttttctttttattatgtaaatgattaacataaaaaaaactccggaagcataggattggttaataaaccgggtatctggctggcttcaccgcgtacaatttattgagcaaacaaaaaatagaaggagaatgcatataccaagatacaatacttggaaaatgatgtggaattagttgttcaaagaattcaataattctcaacttgatgggtaccttagggagagatacaatccacaaaccaaagatcacggtaaatagtagtactagtatgttttttcatatcttttgttggtccctttgattcttttttacttttaaagacaaaaaaattaatggcagacaagacaatgtgaatatacttatgtagtcgtgcttgtttttatacagtagtaagtataaatttgattagataattttactatatacattataatattaattttacaaaataaatttgatttatagttttaaaaaaattttagttataaaaacaccataaaaattagatctaaaaattattttcatgaaatcggatttttccgaaacaattttactgtggattagaaagtcggaatttgattccatcgattttttatttttttattttttgcaaaaaaatccgatcgaattgaatatttactagactaattttttttggctggactagtttttctctaaaattagtcaaacttgaaaatataggctagtttagtccgtataaaataagttctaatttgacatattgtatcgagtcatccaaaatcatataaaaaattgtgtataaaaattttaaaattttttttttaaaaaaaaaaagcaaaaaagttgacttatatggtaaatttttcttaaagattctaaaaatcattagtaaattttattattttaaaaatgttgacttaatgattatatttttaaataaaaaacataagatgaatttggctctttattagttcttcttttgatggttggtaagtgttaactgactaactgagaaacagagtgacgagagaattaaagagacacttgccagaagaacaaatctctcaagtgggacgggacccaccgcatgtccctttcttcattctccttcgtcttcgtcttcttcgtcttcgtcttcgtcttcacttccgccatgagaaaaacctgcacacacgcctgaaaaaccaaatcatcctcatcatcttctgatcta

SEQ ID NO: 423 - DNA, 3000 bp, Arabidopsis thaliana
aaaacgtcaaatatcaatgtataaatacagttaacctgcaggtttagtttttcatattaaggttttgaatcagaaattactaatatatatatatatatatatatatatatatatagatatacatctataatttaatactttgtaattgctgtcaatttgttttttaatatttttaataatatcctaaaatagagtaaaacagaaaaaaacagagaagaaaatgaaacaaatgaattgtgttggatttgcatagtaacgagtaacgattgtgcaaggagccgttaattaacttggtaggggtatcgagagtaaaatcatatatttgacttaagagcaactccaaccataatacaccaaaacacaaaattttggtgtttcaatctttttatcatctccaatcacaacaccaaattttacactaaaaatattacttttaattattatattattaaatttaagattttttttttaatttttttaatagtttgatatacactatttatttcataactgaattattttaacttaattaatataagattacaatcgataaattgaaaataacaaaacaaaattacattgtaataataaatttatattatgtccttttaaattttcttcttgtattttttttttttttttatgtttgtaattttcttttgattttgtaatattgtgtttttcagtgattaatatgtatattttttttcttaatcaatctagtttttgtttgtattttttttgttttaattaaaagtttttgtctggtgtttagtgttttaccgtccgattggagatgtcctaagagcaactctaatggtttgagtctttgaaaggggttttcgaaaattttaaataataaattttgagaaatttaaaactaagagtgtttgttggtcttttgattttttctttgtccaatggtagagtttttaagtgagttttttaaaaagaaaatagtatcactaaaataaaaattataatattttattatataaaataaaactgaataattaatacaaatattaaaattttaaacatacatgatataaaaatatatgtataaaatatcgaaaatggaatatcgattagttattttcttgattttcgtcaaattattgccatatatgctcaattctttcaattgttgatgcataacccgaacacgaactcgtgcgcgagagtccatatagtgagatttgaaggcatatctataaaatagtttaagattacaaaaaagaaacaatttaatcaaaatgaaaaaaacagaagacataatttttctttcttttccctttcaaccaatagcaacttgctacctaggattccttagtcgtcgacataatccctaaacacaaaaatcatctccaaggagacatcaaatcaccaaatttagtgacaattcttctccaacgtgacactataatggacaccaaatctatttttttgttgttttgtgaacagtgtgacaccatattcacaaaacaccaaaatatatatattattttatttaaatttttgatttagttttatatttaaaatgttggttttcaaataaaatacaagtatactatcaatatttttgaatgtttttgttttcgtaatatcaaattttaattaaattaatataaaatgataaagtgcacaaatttttgaaataaatatcacattaattaaaattaaaaatatataataaagcttaattaaacattaaaaacataaaattacaacatttaaaccaaacaaacataaaaaccaaatgcaatagataaatttgaaaaacataaagaaatttaataatataataatgaaaattttgtttttggtgtgagatttggtgtttatggttggagatagaaaaaaaatgtgaacaccaaaacaccaaatttagtgttaaaatttggtgttttggtgtcaatggttggagttgctctaataaactaaattatgatttaatttttgctatataattccagagatcaaccctcaacattcaaccaaaaaataaaaaccccaaaatgtatagtttcagactctctatataaatgtatttataagtatatctaattatacctttaagaaaaaatattttctttacacaaaaaaaaagtgtggctgcttatagacaacatcgcagccattccttttggactggtcatgaaattagacagatcaaaagttaaaaaagctatcgtgtaaaagtaaatctaaagcagtcaagaaaagcatgtcttttattcattgtttactatttctacgtataaaagtagataattttacttttttgcatggcgagagtaattaaacaaatatactaatttctagttttgttaaaaaaaattacttaaagtatttgactagaataattaatgctcgtcagaaacagcggaagcagaacgtggatccttctgggaacgtgagagataactattcggtaaatatgggcaaatggatttcatatagaattaaaaaagtagttttctattatcaaatattggattccaaattttaaaaaaatataaatgttgcatacattatagtattatacatcattttaaaaattcgtagatcttgtttgatttttttttcgtagatccttgatttaaatcactttttattcaacgaaatgctaaaagaaaacaaatctaagtatttaacaaattcaccaaatatatacgacatttatttctattatttgaaatattactaatgaagattagtcagtgaaccccacataaataatccatttccggcggctagaaattaaaaatacatttatgagatcttttaaaaattgtttttaattccgacatatgagattttgttgatttttatatatatgtatgaacactgaaagctttttccaactgtttctttcttcttccattttctctctcaatctctctccctctctcaatcttctggtctcgcctcgtcgtctcttggagaattgagaattgggaatctgttttggttttgcccgagaaaaaaacgagagag

SEQ ID NO: 424 - DNA, 3000 bp, Arabidopsis thaliana
tttggaaatctaataataacaattgtttgacatttcatttattataatgaaaaataaaaatatttatttctattcaacccatattgaaactcatgtgtaatggattcatggaaatatctaataaaagataaataaaaaaaagtttaacagtaatcttaaactattgaaagcaaattatcttaatgaaaaattttaatttgtataattcaaaatcatgaatcaaatgtattattaaacatgctgcgtattaattgttttaatataacttttgagggaaaatccagtaaaaaaaaatcttcaaggtgacaaattttttatttgctcttaattttcttacaatataatacaaaacaaagttaaggaaacaactcagtaatatgatagtttaactttaaactcctaattttattatgcattatatggatatgtaatatcaaatatcaatttctttttgttgttttaagttcttaaagagaatatttaatttattctaatttaacttacatgacgtctttcatatttatcaaattttatatgatttaattttccctttgaaccgatattctgagatctttagtcaagtaagagaattttccattgagagacatcttaaatcatatgctttaaattttcatatgtgaagaaggttcatttattatttcgacttccaaaaaatttcgaaaaaaaaattcccgccaaattttgttttcaaaaatatttttcccgccaattttttttttttttggcgggaaatagatttacaagggattttaaaagaattttaaaagatttacaagagattttaaaagcgtgatttacaagggattttaaaaggtttttaaaagatttataagggattttaaaaaggttttaaaagatttacaagagattttaaagggatttaaaagatttacaaaggtcttttaaagatttttaaagggtttaaaattgttttaaaaagattttaaaatatttacaagaaattttaaaagggttttacaatatttacaagggattttaaatggctttaaaagatttacaaaggatttgtaaagattttaaagggtttaaaagtgttctgaaagatttacaagggattttaaaaccttttaaaattacttgtaaatttttttaaacccttttaaaatcccttgtaaatcttttaaaattcttttaaaatctcttgtaaatcttttaaaactcttttaaaatcccttgtaaatctatttgccgctaaaaaatatttacaaggatttttaaaatcatttttttggctgaggaaaaatttgttacgaaaaaaattttggcgggaatttttttttggcgggaaaaaagtttggcttaaacttttttttaggcgggaaaaaaaaattttggcgccaaaaaattggcgggaaaagttcagtttccaattacatgtttctattagatgagggtaatttggtcattttgttcaagggaaagggtagtttttaaaaatggacaacataaaagggtattgttgcaaaagggtagtgaaaaaagggtagttttgcaaatcttccttgttattttagtacacttatcatattttatatgacttttgttttcctcaaaactgacattcttagatctttagttaagttggtagattttccattgaaacttatcttaaattataggctttgaatttttaaacgtgaagaaggttcatctattttttgactttcaagacaattgataatacatgcatattcattttcacaaaaagaaaaatacattcttgaatattttaagttcttatatagtaaaatataccgttttcacaacaaaaaaaaaaaatcagtttagtgcattgaacatttttaatcaactaaagtgtctttttaacacatcataataatttgtaaacatcaaaattgaaattttatttaattttgagcgatatattaacaatttttaaataaattatatatataatttaacgtctttcaatatatttatcagattttatatgacttattttttttgagccgacatataagatctttagtcaagttagagggtttttcattgaaagttatcttaaatcgtaggctttaaatttttaaatgtgaagaaggttcatctattgttttgactttcaagaaaattggtaatacatgcatttgcatttttaaaaaacaaatactgaataatttatgtttatttttttggaagaaaaacttactgtttcacaaaaaaataatttaaaattaagtgcataacttttaatcaactaaaatgtctttgtaaaaaacattttgtaaacatcaaaattgctataattaattattttgagcgatatattaacaattatagataagttttatatataatttaatataaatattattttatattcaaaactaaaatcgaatatataatacacgcatcgcgtggacaacttctagttaaaaataaattttagttttgtggtatttttggaaaatcaaaacttacagtgatatttctaagaattgcgtaagcggcaaaaaacacaaactttgacgtgtttgttttatttgcgggactttgcctcatagtggtccaccccacttaccaaaaaaatccatgaaacatacttattttcataagtatttttttaaaaatccacttatataagtatctaaaaaatatgataaatccacttatataagtataaatcgtcaaattaacaacgcttacttttataatttaaaacaaaaatcaagattagaaagcagtcgacgaacccccacacaattattctgattcatgtccggcggctagaattttttttgttttaaaaagattaatgagaaattgtaatactttacatatacatatgaagtacgaacagtacaagcttgttcccatctctttctttcttctttcctctttctctctcagtctcttcttatctccctctcttctcaatcgcttggtctctttgagaattgagattctttttggtttgtcccgagaagaaaaagaagagaa

SEQ ID NO: 425 - DNA, 3000 bp, Arabidopsis thaliana
cttggtatggaaccgggagctggtagacacagttcaatttttatctgatggggaatctctctcccttcggcttgcaagttcagaattgggtaggaatgaaaggcccttattacatttgaagtttcagctttctttatatgatgttttttccctctgcagcatggttttaagtttttgtttttctggtgattatttcagctggtagcaatcgaacaaagattattctaggtactactgtcagcctatctattttcgtaatcttggtctttgccgcttataagtcctggagatacagaacaaaacaaaatggtgagacacaggcactttgttctcactcactctctttccttgtcctcttttttaatctaactcggtaccaaatccgaagcaaattaatctcttcctcttcatctgatacacactacatttctagaattcttaagttgtgtcccaaggtacagtctcaggttgacagttcttttgggaagtctatatggtcagtttaaagctagatgtcctaacggttaatatgttcgcttctattgaaagtcaatgcttatgctaataaactgctacaaattaagcactaatacatgcacacttgttactcgtagaaccaaatcctatgttcatccacagttcacaagatgcatgggcgaaggatatggaaccacaagatgtctcaggcgtaaatttatttgatatgcatactatacgtactgccaccaataacttcagttcctcaaataaacttgggcaaggtggatttggtccagtgtataaggtaatgtatcattctgttctatttaccttttcttgttttcctattctgtattttcttcttctgtagatgactatgtgcaactattcttccagggaaagttggtagatggaaaggaaatagccgttaaacgcctttctagcagctctggacagggtacagatgagttcatgaatgaaataagactaatctccaaactgcaacataaaaacttggttcggcttttgggatgctgcatcaaaggagaagagaaactgttgatttatgagtatctggtgaacaaaagcctcgacgtgttcctctttggtcagtcctctataactctattccattgacctcttcgttcttccatcatatgagaattatgaaatgtgtcgttgtcactactatcactgatctgtactatcttattggatagattcaactctgaagtttgagattgattggcaaaagaggttcaacatcattcaaggtgttgcacgtggacttctctatctccaccgtgactcacgcctcagggtaattcaccgagacctgaaggtcagcaacattcttctggacgagaaaatgatcccgaaaatatcagatttcggattggctcggatgtctcagggaacgcaataccaggacaacactcgcagggtcgtaggaactctgtaagaaccattcttcgaaaacattctctacaagattcatagtcatgatattccatataggtgaacctatttgatgtttgaacagaggatatatggctcctgagtatgcatggactggggtattctctgagaaatcagacatctacagctttggagttctactgttagaaatcatcattggagagaagatctcaagattcagcgaagagggaaaaactcttcttgcatatgtaagttttttggtaaacttgcatatgtaagttaagacttaggtttcctacacttgcagagtttcttgctctaatattcttaggatgtgaaactaaataacaggcatgggaatcttggtgtgaaaccaaaggagttgatcttcttgatcaagctcttgcggattcttctcatccagctgaagttggaaggtgtgtccagattggtctactctgtgttcaacatcaacctgcagacagaccaaacacacttgagttgatgtcaatgctcaccacaatatcagaacttccatcaccaaaacaacctacgtttacagtgcactctagagatgacgactctacatctaatgatttgatcaccgtcaatgagattacacaatctgtgattcaagggcgttaaagaaacagtgtgtgatcgaaatttgttcgaatttgaagtgtgggttctgctcaggtaaattaaagtgatcaacttttcttcattaccttttaaaaatattttctctacttgtaaaagagtttgtactctttattgttgtccatgtgctcatgaagctccaatgttttcgttgacttggtcacaaactcaaacaaacaggtcatcatcatttttttattatattctttaacggttttataaatttaagataaacggtcgaaattaaaatcacaatggttaagttcgagtttttgaggcaattgtgaatttgtgagttcatttattcttcttctggtcaaagtttgcaacttttggctacaagcacatatttttctgagtcgtcgtcactgtctctgtctcttcaaagtcccacgatagttgaagtttactttgaatctggctcatctgaattatgcattgaatgtgttcgatgaaatgcctaaacgagaatttaaattggttttatcattcttttgttttttgctggtcttctaaggttttggatcttcactttgcaacttgcaaaacgtttgtcggtaatttccagttttgtgttgtccttctcgaagaatgcaaaagctcaacttcttggcttagtagaaacgagaaagttgacttatgagtaccacacgttattttctgtggacagtaaggttgggagattctttgtcaaggtcgtctattattttattatttttgtttctctctttgctggtcaatagggtattgtttagtacttgtaatattcaaagaagtagtgtgaaccaagatctagatatttaattatctcaggatacgttaacataaaagtttttttttctcttggtctcaatgctcactctatccccatgaagttttgctcatactcaagttatcttgcagagaaatagaaaaaag

SEQ ID NO: 426 - DNA, 3000 bp, Arabidopsis thaliana
taaattcttgcaaatttcctttttttgatagaaaaaagttgttatgcctacgactagtacaaaagagaaaacctaattaagatcttcacgtaagttgacctagctacacgcttactttttttttccttctcctgaagtctgtcggaataatggcgaatttgcaacgtttttggctgatgagaaaggtcttcaccaccggttgtggtttgacttcaccagcaggtgctggagttatgtctcataggattcttcgtacatccttaaacaaccattattctcacaatgtctttactaatttcacaagaggctttgcaactaaacctaaagagaaagacaataaaaacacacaaaaaagttaagaagacaagacaagtagaggagaagaagaaaaacgtggcagcgataatgaaaggtgcagcagtattggatccatagattcctgagcgacttccatgttataaaacaggtcattcttccacttggacgtcctgtgaatgtaatggctatcagggtttctcatagttttcattgttttcagaaattcaccctcagatttgtttcatacctttaggctaatctgtcccacatcgtagacaatggactcgttgtgccattgaaattaaagtctcctctcctcctgttacttgatatatgcatattaagaaagtattatttatcgaatcatccatgattctgatttataattaaagtacatgtacactgtacagtaatacagtatgatgatttttttggtcaaaacctgttttttttttttttttttttttttttttttcaacagctaatgatatgatttttctttacttcaacattttctactaaaatgctattatttctaaataagatattttatactagaagtctagaagtaagaaactaaaagtccataaacaagatttcgcgtcgctaagcaaatacgcataatcagttctaacatacatttatagaatttactttaaattttgttttcaggaaaagaaacaaaaaacgaaaagtcaacggctgacatcaaaacaaaccaaagtcaacagtcaaaccttaataaggttaggccatgtgcactcgtttcttctcgagatatttggaaatcggatatcgacattcgccgatcatgtccaaaagtatactatttagaccacttgattttggtttttgattttttgtttccttttgtatttatgtataactatatattcttttaaacatgttgataataaatgtgtcgtggctgaaaattttttaaataaaattaaagcagtttagggcatctaaaagctattagctagtgcggaatcagtagggtttagaagatccaaatctttttttctttcgaacaaaataatccacaaatttttaaaaattgattaatttatcgatttaaatcattttctcagaaaatgtagagataccaacttctttagaaaatagatttttcgcatgatttaacagttcgtaacaaaataaaaattacttttttgccaaaaaaataaattaaattaattacttatacattagtatatgttgaaaaagatttcactatagaattaacaagaagataacatatgtagttaaacatatcgtaataaataaaaaattaatcgatttttaaagttcgtatatttgaatttttgatattctcatgactttttttttcttcaacaatattctcatgacaataatacgtttaatggtgaattttgagaatcttttactgtagttaattttcaataataaacaaccaattgtggaagcctctttgatcggtactcaagttttagaggtttttacattagagagtggttacaaatgctagagataagactgtttatcgttggtatgacacatgtatataataatcgtcagtaaaagatcacgttttgctgagaaaactgaacatcgtggaattgtttgaaatccgaatgattgatcctactatatatagtaggattagattaggatatttatgatgataatatagtaaagaagaaaataaattacaaccaaaattataactttcgagttctctaaaggaaattatttaaattaagaaatattttctatttatgtaatattttcaatataaatacaaattaatttacagcagctttatactaaatatcaataattaacatgagacatttacgaattaaaaaactgtttcaattgttacatgtctattaatatatagaagatgcatgtatatcgccccactaggctatgattcttgtaataatgatgccaaattgatattgaccatatatttttctctcatttttttttttttttggttcagtgaagtcgtggtcgtctctccataatcagagttgttttattggtgcatgtattattagctcctcaccaagtcaccaaccactttccttctgacttctcaaaatttaatgtttcgtttcgttttagttttcgtaaaaaaattcaactgaattatggttataacttataaactttcattaaatcaaaacatatttctaatgtttttcttgcctttttttctggtgaacaatcaacatatatttttcagtaagctccataccctcgtcagatttattacagatcaatgaagtgtagcttattggcagaaagacaatcttcttcaatgacttaaccagatgaatatttagttaaaacaatagtttaaatattttaaaatcgaaattattggtgaaattttaagattagctaaattttccccgtaatgtcattgtctaactcgaatttagaaattctgcatttttgttatacgtcaacgcctcttaacgtaaaaaaattcacaattggtcacctctaccaaaaggttgactttgagctcatcataatagtaaccagtactaacgcggttcagacaaaaagaaaacaattccatctttcatttctttaattacaccacatatatcttcttttgattcttcactttctagtctcacaaaaacaaggaaacaattaaaaccaaagtgacgaatatta

SEQ ID NO: 427 - DNA, 3000 bp, Arabidopsis thaliana
cgagaacatgattgcttatgttttggctcttcaacagaaacttaagtggtaataatctcactggatcggtgcctctctcacttcttcagaagaaaggattgaaattaaagtaaatttattttgttttcccagctttttctaattgattaatatgtctttaacatcataaaatgttgcagtgtcgaaggcaaccctcatcttctttgcacagatggtttatgtgttaacaaaggagatggacataagaaaaagagcatcatagcaccagtggtcgcatcaattgcttcaatagctattcttataggtgcattggttctgttttttgttcttaaaaagaaaacgcaatcaaaaggtaatggtgtaattattacgctcaagagtaatatcactatatacataaatatcaaacttaagttctaagtctgactacctttttttcttttttttgtaaccttagggccaccagcagcatatgtacaagcgtcgaatggtagatcccgtagatctgcagaaccagcaatagtgacgaagaataaacggtttacttactctgaagttatgcaaatgacaaataacttccaaagagtgcttgggaaaggagggtttggaattgtttatcatggtttggtgaatggtactgaacaagtagctattaagatactctcccattcttcatctcaaggatataaacaattcaaagctgaggtaaattcacactttcatcattatctaattgaaacaaaagcatcaatgattcaaatattttgaaggatatatatctataacttctgatttctggctgggtatttaggtagaacttcttcttagagttcatcacaagaatttggtaggccttgttggatactgtgacgaaggagagaacttggctcttatatatgaatacatggccaatggagatttaaaagaacacatgtcaggtaagacaataatgactaactgtattttatcagttctatagtgcgaatataagactttagcatttatctcaaagtgttctttttaaacacaggaacacgaaaccacttcattttaaattggggaactagactaaaaatagtcgttgaatctgcccaaggtttgtttcgttcttttcttttttcatatacttgaagttttcaatattgtaaaaaactaatgtttgtgacataggacttgagtatttgcacaatggatgcaaaccactaatggtgcatagagacatcaaaacaacaaatatattgttgaatgaacaatttgatgccaaacttgctgattttgggctctcgagatcattcccgattgaaggtgaaactcatgtttcaacagctgttgctggaactcctggatatctcgatcccgagtaagtattacctcttaattaagggattttagtttttccttcaattacaaagcaacccacataaaatttgttttctatattattttccagatactacagaacaaattggttgactgaaaagagtgatgtttatagtttcggagtcgtattgttagagatcatcacaaaccaacccgtgatagacccaagacgtgaaaagccacatatagcagaatgggttggggaagtgcttacaaaaggagacataaaaaatataatggatccaagtctaaatggagattatgattccacttctgtttggaaagctgttgagctagcgatgtgttgtcttaatccttcatcagctagaagaccgaacatgtctcaagttgttattgaattaaacgagtgtttgacatctgaaaattcaaggggaggagcgattcgagacatggactcagaaggttctatagaagtaagcttgacctttggtaccgaagtgaccccattggctcggtagtttacatgaagaattcagcttctttttgaatttttgaatggtttcttctaaacaccatgtgagaataagtcatccacatataaccatacaatgtttttctaagttttcttactctcaaaattttgtgttcagcttgaggttaatcgaggtatcctagtggttaatcgaagtatacttcttcagtgattttttcaattaaaactaataattttacatagttaatgcaaactccttttcaatccgaacggtatcatgttttgagattgccgttttttttttttccattttcgtccgtcttgctcttgtaaatgagtaaatccatttttggctcccactttttccttttcttatggtttttcgggtgaacacgcataattttaattgatcatcctgacttattcatccatagcaagtatccacattcttcttccatatcataaggaattttttcaaccaaaaatccaacaaattatacatataaaatcattggagattgaattgagatgcaaaaacactatatatttttattttttttgttcaaagcaaaaacactatatatgatgtataaattcgaaagaattcgagtttcacatatacaagccttttgaccaaaaacacacactacaagctggatgatggttgacttctgacggtggagattcaattacgaaaacgccatatccatctagaacgaaagacacagaaagacagatcaaacaatgacgtgccatataaaagtcaaattcaacaaatctgtaagattattaactagaacttagaaggttatggtttaatgcacgtttcctttctagatattattcctagtttttcgacgtcgacaacatcaaaataaagcgtgttattttgcgttgacggtttagtggtctaaaattagtaaagtacatgagagtgttttcgacctcttgtcatggttgaccaaaaaactaaagagtttgtcattttctcacaacttgttctatcgaaatcgaattattttccatcctgaaaaaaaaggtctcaattatctatttatgtagctgacttgagacttttaaaagtggctcataaaaatcatatatccttatatgcatagcttgatatctaaagaaaaggctctttcttttggacagtaagaagaata

SEQ ID NO: 428 - DNA, 3000 bp, Arabidopsis thaliana
ggtttcttctggtttggatcttgttcttgtgatatgcatcttaaagagtttcccatttttttttggttttttggtttttcttgtaaggtgtagacacgtttgtaagtgtgtgtttatatatatgaagcatgttcgtgcttgcatgtgtattgttttgattcttgatgggtgaaaatgaagagttgagactctcacgttgtgaagctgtacttaaaatgtaaatctgtttgatcgtgatagttttgacacttctgtttttcttgagactcacgaaaatgcacatatgagaaaattggtttaaagtttggattattctattacaaactaatggaaattgattgcctacaaatggagacataagaaagagggaggaacatgggagggcactttctttgagcattttgctactttgactttcaagcgcaagctatttctttacaacgataaaacatattcatcgtatttttcttgtttatatatagatcttcgtcctttgccgcgactgcgatcgactgcgactaagtgttgttctgatcgggactattgaccaatattttaggttgctaatttttaacgatttctcgcgattggttacataatgactatacaaaacgaataatatagcaatcacaaaataaattaagatacaaaatctttagaataaacaagaaattaaattattatttttttataataagttttagaatagatataacaattatattttttattttaaaatataaattctcataaattaaaatcttcaaaacaataaagcgaccaatcacatcgattgttaaataaataacaaaacaagttgctggttgcttgtcggaatcgttggcaactagtaaacggaacatgaccctagttaaaaaccgaaatttatgtaaattttttgatatagctcttctcaattcagaatcgagttctttagatgtacctaactctcactattagtttacttctaagttggttccttgaatcttaatttgtctcttgtctcttatccaagagatagagaattcattaaaataagttatctttttgagattatttacttttttccaaaaagtgtcattttaaatgttcaatgcgaaattttagacaaaattttgtttcatattttatctattaagaagagagatgaaattatataatgtattaagaaagaatataaaataaattttaaatcatcttttttatgaaaacactgtaaaaatttataaatgcaacggaaggaatatacattattcatctactcaaggtagacgaataaagagaccaacataaaaaaaacatgtgtgaagaaataaatttgtgaccgtcatgaatcatgatcttgtgcaaaatttttacaatatatattagattaaaagataagatatgattgaaaatgatgtatactaaattagtgacatattctttcacaaaaaatttttggaatcccatattgagaaatattattaaaaaaaatgattaatacatttttcaagctttgtaataaaaaaatctaatcacgcttatcaagattctttctatatcgtcgactcttctttgtagtcacacttcaaattacattgtagtctcttattaataatttttgtagccacacttcaaattttttataatgaaaattagtgttgctagtcgttgcttttgatcgttgaaccagaaagtaagatcctctttctttaacccctcttaatctaaaaccattgctttctaacgcaagactcttttactcggataatttgtagttgactatgatggaagcaaacggtctggaaaaaccaaaggtggacgcaacaaaactcgggatggctctgcaaatagcatcaagacagatggaacaagactgagaatagctctgcagaagatgacgaagatgaattcaagcaggtcagaagtcgtaggaataagaaaaatgtgaaacccctaaggttcaagcacattgatgatactctctactacaaacaccaacacaagaacacttataatttggagatttcttagaatgcaaattgagattaattttcgacattacagattcaaaaatctttacttttttaggttgccgtcgctaatttcagtcgccagcaaaaaacaaacgaatatgatttaattattaaagaagtaaaaaaagatatttgattgaaaagtaaataaacaatgaatatcttacaagataacaaaagctacaaaacaaataatcttagtattttaaataaaatatcttacaagatttacttaaatatattgatttttatttactatttaggtatctctaactaaattaaacctagattttctttatcttcaaaatttattatcattaactatatatatattcaagaattaaatatattgaattataatattaacataaatacacctaaaattctagaaacttctttttaatatcaaatctggacaagagctatagttcataagtgtcacatggtccgaaacactccgaaccctagtaatacccacacgaacaacttgtcgagtgcgttaagatattcctttttctgatttacctttttaaccctggttaaaaagttcataggtcggtcaactaaaaaaggcaaccaagtcaaagaaaacaatttttactagttgagttcggaaataagaaaagtgaaaaccaaatcctaccttaaacagaatttaggaaaatattatatatttccttcttccacatcaccgatttataccaaaatcatataatcaaggaacctctctaaaaccctattaaatcttctctctttcgttcttcttcttcttctcctcctccatcctccaaatctcgatttcccaaaaaaaaaacctaatctcgccgtactctcctcggttccatctttctctgcggccaggttttttaattgatccgaattcagatttgttttttttttttgtgatctagggtttcggcgatttgattctgaattgctctgttttgtttttgtttgtttggtaatcagtacgtgtgcagat

SEQ ID NO: 429 - DNA, 3000 bp, Arabidopsis thaliana
cacgtggaagaagttgagacagttcattggaatttcggatttcccaattttcttcttacagttacagctctctctctctttctcctctctaaacttgcttccaactgtctcttctctttgccacgtttcctggcccctactttgctttacttgtctccatatttcgttttcttaatcaaactaaaaactatctcaaaacaacaatatttaatttgcattttgaaaaaatattcaaagactttcaaaagtctatttgattaagcattgttggttgtttgggcttatttgtttaagtatagctaagaaacagttttctttgggtttaaaacaaagttttaaatggatatatcaaatatatatcttggacttcaaatgccaaaaaaaaattatttgtcttcttggacgatatttgaataagcaggcatggataattgttggtacatatatatatatatatatatatatttgttaaaacatttaaacaatatattactagcttgtttttcataaatagtttataaagccttttcaagcctttctttctacagtttctctttttaatgtctttttgtttgtaaataagaaacaattacacttataaatattgagtttgtgtaatctttatgcataaaatacaacttatacagggttgggcatagtgagaaaaagaaaagtggaaaaggggatttaaaataatgatgaggaataaggatggtcgtgcgtctatgaaagctgctttgcaataagctcatctcatgtaatcttttacaacatgttacatgtatatatattcctttcatcttaatatgcaactagacacacatacatatgcacggcaaggacacattaatatatatatatatatatatatatatatatatatatgtacataatggtactactttggagtacaaaatagttagataagtcaatatgttaatcgaaatcgttaatttctagataaataattcgtggacagatgatgattcttttagcaatttcattgtgtgacgaacatggtaacgacaaggtttagatcactaaaacaaacaaaatagataactcaatggtcaaacatttcacatttgtacttttaaattttaaattaataatgttaagagagtttatatagggtgcatgtagagagaatattaatttagatagagtcgtctcctataatctaagaatgttaaatttggattatacaccaactatcgtggcttgaaaccatacatataaaacattttattaataagtaaggagtaaggaccatgtatttaataatattgcactagacactaaatattatggctgattcaacatgactacatgatcactataattatcgtttcagagttgtaaaatatgaaggatgagaaatctttaaagggatctatccgaaagtcaagagcctcttcgtcaatactcaatattattttgatttattttcctatatggtttggtaggaagaataatggacttccactaatcatgaaaactcatcacaaaatctgtttggcttaatcattaaataaatatttgatatttgacacacacacactttacatcgttttaacaatatgattgagtgcatatatatattaattattttttataatatgaagatcgggttgtcagttagctatacatgtccttctttatgataatatacccaaatcagattatgggatcacgaaattatgccaataattattctaaaataaatatttaaatttagaattataactgtattgaaaatagagataactaaaagaatgtaattctaaaatccagactgttcttttttcgtccgttcatagctagctttccagtaagctaatgattaaaggaaggttaagtacatgttagcatgtgagaatagggaataagttccattattcaatacaaaaaaatatacatatgcttctaaactaatatagaaaagtatatattaatttcatgtgaaaagaaatataactattattggtctatatgtatcacacgaaacctacagagacaagcaggaggaagagaacaagagaccaactcaaaagtgaacatgggaaatgataaaacaaaatatagaacttatcaaacaactgtagttttgacaaaatctgcatattattaaatactacttactacaaggatttaagatatttttccttaaatcacccctaaaaattctacacaattagaaacatcaaaatattcaataactttctaataatgacacattatagcatacattattctccaatctttgattgaagaatgtaagaatcagtattaacattataagtttgtttctaataacatccaaaaatgagtattttcaaaatctaccgttggttatactaattcaaaaataacaaaaactacgtgacatctggtaaattatgtacctttagtatttaagatatatagttaagaaagaattaaatctgcatattacataaaaatattaaatatatatacatcagaagaacgtcgttataattaaaaagaagatttctgaataaaaagttgtggaggagctataatgttaaaacctggcaaattagacagcgaagacatactcaagtgctgccttgtcacactctctctctctctctccgtttccttgttacaaaaccctccaatctcaattctaaaatgtcccaaaactatcttattctctatcttctctcttccctcttctctcttctcttcatatgtgtagggtcgaagacaagaacgacaccgtttcaagggttgcaatttgcaaccttttgattggtctctcttctctttgcccaaccaaaaacaacctttgatgatataaagatcagccaactttgtccatcccaattctctcttttttttttgtttccctaatgttttagacaaacacaattttccataattatttatttattcaatttttatctgtttttgggttacatatatcatcatcattggagactgccatatttgttaatcgtgatattaatttaacta

SEQ ID NO: 430 - DNA, 3000 bp, Arabidopsis thaliana
ggttgaaacttacaccgtggctaactgggttggtccagctaactggatccaagaagccaacgtgcccgtccaactaggattgtaagaggacaacacaaaaaagttaagaataaaacagtatgtgataatgttaaggtaacgatacgacgtcgtctctggggatcagaactcttttttggatactatatacaaagatagggttctagacgtgttgagatgatgtttgtataagattgctttcgtttcacgtgcaaaagaggaaaaaaaattgttttgttattttttttgtagtacaaataattaatttttttttatcacatgttgtatccttaagaaaattgatacacaaaatattttaaataccatcatttgctaaagtttaccatattccactttcatgattattcttacaactacaaaaataaaaataaaaaaatctagtaaaaataaacaaaccaaagatatttatttcacatacgtgttaacagacatgtactagttttgacttttgacaaatattcacagattttaattattttgcattgctattgtttaagtctagatagatatattttttatgagaagtgtaaaatgttagcaaaagcgagccctacatcacctaattatagtccacttcaaagcgaagctgtcccatagataagacttcaccaatatctcacacaatatataagtatagcagtcttctaccaccagaaatgtcacacaactcctaagccaatcttttctttaatcaagtcaatcttttcttcaatggctttttcattaaccagagtaaaccgagttcttattcaagcatgtgaaacgaccccatcagtagtgttggatctgtccttaatcgataatattccggttctacgatgtttcgctagaacaatacatgtgtttactcatggacctgatgcagctagagccatacaagaggcattggctaaagcacttgtctcttactatcccttgtccggtagattgaaagagttaaaccaaggtaaacttcagatcgattgtaccgggaaaactggaatttggttcgttgatgcggttactgatgttaagctagagagtgttggttatttcgacaatctaatggaaataccttacgatgatctccttcctgatcaaatccctaaagatgatgatgcagaaccgcttgtccaaatgcaggtaagtatttaatctacaatccgctagaaccggtttgtttgacaattagtaccgatcttgaattatgaacggtagttttcaaaatccggttcaacggttaataaaaagcagttataaattaaaccgattagcttgacgactgtattcgactgaagttaaactgaaccggattttataatgttactgcaggtgacccaattctcttgcggcggtttcgtaatgggccttagattttgccacgcaatttgtgacggccttggagcggcccaattccttaccgcggtcggagaaatcgcctgcggccaaacgaatctcggcgtctctcccgtctggcatagagatttcattccacagcagcaccgtgcgaatgatgtcatatctccggcaatccctccgccgtttccaccggcgtttccagaatacaagctagagcacttaagctttgatatcccatcagatttgatcgaacggttcaaacgtgagtttcgtgcgtcgaccggagagatttgttcagccttcgaggtcatcgccgcttgtttctggaaacttcgtacggaagcgataaatctgagagaggatacagaagtgaagctcgtattcttcgctaactgtcgtcatcttgttaatccgccgctcccgattggtttctacggcaactgcttcttcccggtgaaaatctccgccgaaagccacgaaatctcgaaggagaaatcagtgttcgatgtggtgaaattgatcaaacaagcgaaaacgaagctaccggaggaatttgaaaagttcgtcagcggcgacggagacgatccgtttgcgccggcggtgggatataatacgctgtttttatcggagtggggaaaattaggattcaatcaggtggattatggatggggtccaccattacacgtggcaccaatccaagggttgagtattgtccctgctggcatcgtaggatctgtgccgttgccgaagaaaggtgtacgtttgatgacgtggtgcgtcgaggagactcattgccaattgttcgatgatttgatgacaaataaattgacatctaacaaaaccgaataatcactaatccagtttattaaaatattgtatagtggaatttgggaaaacgagtaagaaaattcattggctgcttgaaagttgattcgttacgtactgaagtgtaatgtgcacataataataataataaaaattgtaaagaaaaagttatgagtcattcatttgccagctaaaacaaatgcaagttgcatataagaaaatcaatctgaatttgatattttgtctgcatacaatagaaatgcggttaatggcaattgttttatactgtatgaacaaagcaaagtaaatgttgattagtcacactaaagtttgaaagaaaactcgttttttggtactcttttctttgtgaaagaaaaagttaggtgctaataagactatccgcagaacagagaccagaccacttggcgtctgacctgtcacgtcataacaaggtcgtttttgacgactctagtccttgtttctggaagtaggtcctgaacttccacttgaatcaattcaatagacgtaaacgtcttaagagaagttcttgaaatcgaaaatccactgcttcttcttcaagtaatgaattagagtatattatatattcaaccctccacgatccttgtttcctcggctactaagaaaaggaagtgtatctgtgtttttcaggtacatgcttctctgttttttgttgtccaataaagtttaaggtttcagttttctagattttaaagtttggatttttagctttggttttcttgataggatcaaagaaca

SEQ ID NO: 431 - DNA, 3000 bp, Arabidopsis thaliana
gatcttgctgctgctggtatccaaaatttatcagatttggtaacatcaaactcctcaagaattctttcctttcttggtttctttaaaaaaaatcatcaagaatatgtttcttgattcattctttttttctacaactttcccactctttaaacattatttagcttcatgatttttctacgcagagtgatgatgattccaagaatcaaatgctaagaaagaaagagttgttgcttcaaaacatagaccatgcagtgaatctattcctcatctacgttttgacattatccatttttcctggattcttatacgaaaacacgggacaacacggactaggtgattggtatgcacttatcctagtagcgacatacaatttttgggatttgttcgggaggtacgcaccgctggtgaaatggctgaagcttgagaatagaaaggccctaacgattgcggtcttgacccgttatttcctcgttccggcattctatttcactgcaaaatatggtgataaaggatggatgattatgctcgtttctattttgggattaactactggacatctcactgtttgcattatgactatagcccctaacgggtacaaggtaatctatctactctccctatgctgttaaccaaattaatttgaatatatctagaaacttagattagttcatatttagaaaacaaaacacattatctttacaatttttttgtgttataccctttgcttttacgatttgaaaatataacacaagttttttttgacatataaatacaaacactataataaacaaacgacctctaccttcatatttaatctgattttgtattttgtgaagggtccggagaagaatgcattagggaatttgctggtggtttttattttaggaggagcagttgtaggaatttctttgggttggttatggcttattggcaagaaatatgctttctgagttctcatcattttgtgcaattaattccgatgaatctgactctttatggcaaaaaatgagaagcttggtgcctcgctcgaacctaactgtttattcatgaaaaaagaagaagaagagaatactaacacgtaaaactttcgaaagcttgaagtgatgaattcttatttcgatgcttcaccaaattataaaatttcactttttcaactccacaatttgctgtatctattttagttaatattttagacccatttgatcattttattaactattttctaaaatcttatatggtgttatttaaccatagatttttatagaaactaaatcctaacagtctacttttgtttgatcactgattataattttatgcattaaagtttagcattgttccatcagatatttgtaaaacaaaattaatagcaaaataaagtcattcatttaagctagtaacggacggttttcttcgagagaaaaccagtccggagtagaagagcttacatgggaaaacatagaacctcgtgctcttttcttcttagcaagacaatcagcagagacattgtttaagtatgtaataaaagataaagaaaaacgagaaaaactaggctttgaagcattaaaatcttttcactccgaagaaaaagcggactactcatcaggagtgttcaaaagttgtgtcgactccttactatctgtctataaaataatgtcgaaaatggataaaaatataagaaatcgtattgcccataagagagcctcaacagatatttgtaaattatatttaagagttttaaaatttggtcttattaaccaagtgttcatggccaagtgctttcgtcatgttggtccagactagagaacacttcttttaatcatgaaaacttaactcattgtttcctttatgtaaacattttaaagtggcaaaagttttttcttaggtatctacaaatattgagaactagtttcggttacgatccaaaaaagaagtaggtgttatttagttaagattttaaatattttgctaaaataagatttcaggcattttcgtgtaatttacaaatacaaaatgtagtgtgtaatttagacccatatttcctttcaaactaaccgatcaaaacattgatcacaaaatccttgtgtgcaactaattccccaaaaaagaagaggagaatactaacacgtaataatcaatttgaggtgaagtgtttatttatttattttgctaaatatttgaggtgaagtgttattttgataaatgcttcacttatcctttttcttttttacaacaaaattagttcatccatttaaattagaaacggatgattttttttaggagaaaaccagttcataataaaagattttatatgaaaaaaagataaaactttgtgctttttctttttcggcgaggcaattaataccaatattgtttaaacgtaaaataaaaagataaagaaaaacgataaaagttaggttttaaaatattaaaattttataattctagaaatgtccaaaaactaagtcaactacttcaaatgcttcacttatccaacttcaccgattctcatcgagtctatttcatacatagtttttattttcatttattacgtttagaccgatctcacagatatgtggatatttaatgattaaggattttaaagaaagttttgctttcatactatatcgtcaacaagttgtctaaaaataggaacataaaaaaagctttcacactttgaattctttaaattctataatcttttctttttctttttgagtcttactttatcctttcatatttgctgtcacaccttgaaaaggtctattattttactcgctcatctcctctttttaagaatcttgttttgaatcttcatgaaagctttgctcgttaaaaaatcaacaaactcgttgactctgcaaaaccctcatgtgctaagtttcaagtaagtatctctagctcctttatttgctccccagcaaaaaaaaaggaacatagcatcatcttgtgtttgatccaattcttgaatcttgaaaacaggtttatgttcttttgagctca

SEQ ID NO: 432 - DNA, 3000 bp, Arabidopsis thaliana
tgtacatatgataccaataatttcagaatatttttcttctatatataccaataagttttcttaaagatgcaaatgcaatactctgctttgtaattttgcaatgcatttgaaacaccgaatcaagagcaaacaacgaagtcagagagacaaataggctaaaacagagctttgagcaaaaaaaaaaaacaagtgaacagatataatacccacttacttggaagccactgacataacagataaacaatgtagtgacttgcaacaaaactccttaaaataccaaaaacgtatactctaggagcttggcttcttgtatctttgttgacttctgatttaacgtcaatagacactgaggaaaaagagttctcttagagccgccattcaaaagttttaagaattttaagtcaagtgtaagcaaataagaaaggtcaatggtcagcatgagactactaaattatgatactgctgtcatctatcacctgacccatctttattattatacacaaattagtaaaagtctgccaagtttgattagtgcaacttgtatctggggtatttagttactataataaatatcattttgtgtataaagaaaggtctcttctgtatctaaaagacatatcaaacgaaagaaatcaataaacacaatattctttcttccaaattttctcatttctcatgggcatatctcaagtacactattgcaatggtaagcaaaaggtacctgatgacgttagatcatttgatcctctttcgatgaaatataataaccacgagtgttaatttttcaggtgaccagaacttagaagcaaaccttctagatcatgaggaaactgaatcattttcagtacctcaaacgaagaactgtaagaggtggctccgtgtctccatatacgcaatctttgtcatcttctgccaaccacttgctacagttctgggtagactgtactatgaaaatggagggaaaagcacatatgtggtaacacttcttcaactcattggcttccctgtactgattctcttccgcttcttttctcgaatcaggcaacccaaatcaacagatacaaatttcagtcagtccccttccttcaccacccttgcatcggtttacttgtgcactggactgctagtgtctgcttatgcttatttgtctgcagttgggttgctttacttaccagtctctactttctccctcatcttggcctcacagttggccttcactgcctttttctcatatttccttaactcgcaaaagttcactcctttgatagtcaattctttgtttctccttacggtttcctctgccctcctcgtggtcaacactgattcagaaaacacaacaaatgtatctagagtacaatatgtgattgggttcatctgtaccattggtgcttccgctgggattggattggtactatctctgatacaactgctcttcaggaaagttttcacgaagcatacatcctcagcagtcctggacttggccaattaccagtctctagttgcaacttgtgtggtactcataggactgtttgcaagtggagagtggagaactctgccaagtgagatgagaaactacaaactggggaaagtgtcatatatcttgactttggcctcagcagctattttctggcaagtatacactgttggttgtgtgggattaatcttcgagtcttcttctgtgttctccaattccataactgctgtgggactgcctatagttccagttgtagcagtgatagttttccatgataagatggatgcatcaaagattttctccatcattttagctatctggggcttcctttcatttgtctatcagcactacctcgacgaaaagaagttgaagacttgccagacaaaacctgttgaggaagaaacacaaactttatgaaacaagttgtatcgaaggtctcagaaacaaacatacatagttgtacacagtcatgtaaataacctatataaagcttgtatgtgtaatatccgtaatggtccatgcaaatgggatatgtatgtcgctcatatttcaggtatttagaacttttattcaaaagagtattgtgtaatacgagcagagtgataaaagcagtcatttatttaacagaaaaaccatgtcaattttgtgatactttcattgtgtgagtgtgaaacccgataaaaattgaccagttagcataacttacagatatgtcaatgcaatattctcctttctagttttgaaatgcacctaaatcttgggaaacaagaacaaacagcaaatcatgtataatgagagatagaagataatttgtcagattggtccaacatccttggggaaacagagctttgaacaaaaagtaaatgaccagaaataataccattttatatagcgacttcctctgccgtccagtattaagttgttgcgaatgtcttctcttgaaaagataggcgagacataatctttagctaacgtcagcatcatcttgatggcaaaaacttcatgactagccatggaaaccgaagtgtgtacccaatccaaataaatttaaaaagacaaataacttttagaaatgtcgtcctcatcaagatcacagaatactacaacttgtgtacacgttcatacatatgcgtatgcgtgttaagtttctatttgtctatgcgtatggggttcatgtcctccacatagttgcagaagaaagtctgaatgaatattgcctacacataatttcctcctagacttaactcatctcttggtcaacaatagaggcatctttgcatgtagaaagactacagatactaaattcatggaaagagaagagatatggttggcatttactgaatgtggggccaagaacaaagaaaacttagacggtgaccgattcctaatcccagaatatataacttagcatatctcacccatatcaaaggagcaatcacttggtagcattatcaaccaagagaattgataataagatacgttagttcctccttgtccatctccaaggtggtgattccacatccacc

SEQ ID NO: 433 - DNA, 3000 bp, Arabidopsis thaliana
tataaaaaggtttacattaaaaatgaaaaccatattaacactatataaaaacttagcctattactagcttaactttttagccacaacattagtcaattgaggaatattttttttgcaaaaaggttagtctatagaaatttgatttttgaaggtcgttttcgttggaagacataaagcttcttggttgggtgaatttaaaaaatattcaacgtatttttggagaacagcttgcagacgacaacatccttcaagttgccacttgaatcctcctcaaattggctgcttaattagcatacctcaaaatatatatcaattaaaaaagaacgtcacttgttagtctttttcacgaaataatatattactatttttgtcgttatatataagttggtggttggcattttgtcttatggtccacgttaatttcgtgagaagcctttagcgtgtttcttttgagttttttctttcatttgtcagctcgaaaacaggcggaaattaaaccaaattattattacgtgttccttaatatcgtgttttgtttgtttacaagatatcgtatatgtgatcaacttattcttgctaacttgtaataatctgttctagttatactacccactttatatcattgcattgaagcgatgatgaatatgtcttacatgagcttatgatatagattatatatatccggtatctaactaaccattttgaataaatttccttactgatgtggtgggcaaaaagtttacgagtcggattggttggatccgtgttgggttatattacattatatcatattcgcattttaaaaaaaatttattggttaggcgtaaattaacttttgatatatgatataatcgcatagttattcaaatggtatagtccaaactttccttccaatacagcacaaccatttaccatgttcacatacaagtatacgcatcacatactttacgtgatgatttagagatatttagatattagtctgattttaagttcaaagacacgataaaccaaatagttatattacatcattgagacttgtaaagatttcatgaactaattctaatcatgagagtaaatagactttaaattgaaaagtactctaatgagaagagtaaataaacttaagtgaaatatttcatatatatactgtaactctaaatcctcagggaatcaggaatttataactcatatttgagtcctattaaaataaggtgttggattttgattatatatttttatttgttgttatgattgaattttgatttatgcaacacaaatatatatataaagagaacgactttgtattgcttagtaaattgtcgtggacaaattggattttaatcaggcgatattaacacttcaactgccgatcatccatatcaaaacctaaatcaaggtatgtccgttcaaaactaccactgttctacatttagtatttaaacctaaacattttttttttttaaacctaaacttgttcttaaccaagatgcacgtagtatcttgtgaatggttaattaacttaatttagtaggacgtaacaaagttataggacattactagaagtctagaacatagttctttcgtgatcattaaaacttcgatccaaatttttttgacacaatgtgtattaatttagattgttcgattcagatttaggtctaactttcttaggtaaaaaagctggaatttgtaaatatccccaagcttcaatgaatctagacattaattcgacagataagatttgcgtaaaatactatagaagatttagatgtatttcatattttcacttatctaggtttcataattaaccaatcagcgaattggtataaattaaagtttggattgccaaataccaaacatgtttgtatttatccatccaaatatgaaatcaaatataatcctatttttgaaagataaacaattctgttcacaaaaaaaaatcagaaagaaagataaaaacatagtatatgtgagacacagaaaaggatctaacacaacaaaaagaaaattaccaaaacgtatcaaagatttagacttaaattagggcttaaacatggattaagaatagaaccaattataatataagttaggagtgaggaaagtcgtaatcgaatacagctacacacgagcgtagcgtgcttgaaagagacaccaaatcctgttttagtggggaactttcttactttcactttttcccctcttttttttttcctatttaagaacaattatttggggtttttactctttttattttccctcatgttttttgattttatcagtctcttccagcagccctccaggtgtaactggtcacacattcgcttggcttacctttaaccaggtgtttctccttcttcatagattttagggatgccaattttcaatactacgttttaagttcctataccgtaatttatggttttattcgcatataacagtggcatttccgtttttttcccacaaagtcagattctcttcaaattaaaatttttacataactacttttcgtattaaataaatattttagaacgaaaaagatcatttagatttatctcttttaatttttattcataaaaactagttaaaaaattaaaatagcatatgattattattgagataacaaaattctgtcgagaaaaatccaccgaacatatattttagcagcccgtttcaaaacctttacaattaaattgattaaattaaacaccatagaaagaaagagacgtcaaagaaaggatctcttctgagttctctgactcaatttctgagctctctataaatataagctctcttcttcacacttttaatgcaactctcaatatcactattaaatatctttctcttttcacttcttcactttcctcgattcctgagttttcgatccttttgttctctaaccaccggtttcctctttaaccggtctctggataatcatcataatcattaggatcatcaagataaggaatctttttgagtatatctctacaccaaatcgaatct

SEQ ID NO: 434 - DNA, 3000 bp, Arabidopsis thaliana
tacgtaacaggtgtgcacactatacacaaccaaagcgttagataaagagtatagtaccacgatttatatttacgataatatatacttttgtacatttagacaaattgcaatgataattttgtctatatatcataaattcaaacatctaaacagacttaatcgcttgctgaatgctgatcgcgaacgctaacatatcatatgagtcatatcccaaacttgtggatatactaatggtttatgttaatgtaactgtatgttaaaacattaatcagcaatgtatgattttataagagattcgaaaagaatctgacaatagtttgtgtgtcattataattatttccgttcaaagaactaaattttgtaagtggtccaataatcaaaaaacattttttatatgttcaatcaaccgagcattgacattaacttagtaaacgataatacactgaatttgtaatctgactttacaagtatgattgatgattttttaattatcgatgaacatttcaaatatattattattatgttgggagaaagaatggttttgttgttttgaaacataaatgcttttatttcaaactaatatcatattccctgtttagttaggttactaattcatatagatttttttttttaacttttggattaatttttgacaaaggtctggatacaactcagttataaagattgaatggaagtctaactttatggcacgtgtatataacgaatatagtgatatcatatactgtatatgagtcatatgacaacttcataatgtaaaattatccaaattgactatacacaattattcaatcgctaaagaaaagaacattgaaaaatttaatatataatttaaatgtattactactctaaactctgcattgaaaaattttagaacgtaatttagtatataaaataaatgtattactattctaagataattagttaattagttttgagatgtaaagtttcgtcaagtgtcaacgagcttcatagattttgcgctgtatattattatgtctagcttaaaaatttgctgtatattattatgtctagcttaaaaatttactgtttgggaaaaatatgaaagtctcctctacctgagtttgttttaaccttctttttaaaattatcaaatccaaacatgtgaaattttttggttcagtcaggtacccaatgattcatttttaacaattagaagttggaatatatttgacttaaatttctctagttaaaacatgtgatctgtcatattaattgcactgttgaatgttaatcgaatttggatatgtattcactctttgttatcccatatggcgggttgaatcacctgtcaaactaatattttcaatctaatgtcttattcattcctttgtacaactgagaccttaattccattttacttaatttatatagggatacgtgtatatagaaaaggtggatcggtgttttatttcaagagttttagtcatacagatatactttttgtgcatatacgagatatatggttgtatttctgtgtttaagagcaagcaaaattcgatcaagaagcttaatttggtcaaccttacgttactagaaaggtatgtgatggtggcgaaccgacgataaccgataagagagagagagagataatatacatttgaggtctattttacgaaagagtctaatttgactgtttatttgctttcttcttttttggtggcctgaaatatgaataccaagatagaaaaaaagactaattttggcttatcctacaagtggcaactggcaagtatacaaataagacttgtatttttatctgaacatactgtcaaatttctatgtcatctcatatactaatgttatataattatatgttatacacataatattagttaaaaatagaagtcttaaaaataaatttcgttatactcatcatatcaactaattatcgattctatgaatatgttgggttaaattttgatggtaggagagaagacgaatatcagatgttgacatgtgaacgaatcgacgtcaatgagaacatgcatacgatgaaatgagtgtgtaaatccaatatttgataagtgaataagaattatgtgattaatgggaattggaatcaaggagctcaaattagaactatcaagactagttgtttgaccataccaaaatatggtaaaataagactaatagtatgtgaaatcttagatcttgtggcctaaaggaattactagtgatagtgaaactacattattgcttgagctaataaaccaatataatttaaaacaatgtaccactcacatatcccataccgaaaacaagtagataattagatatttatatattactagtttccaaataccgtccaaattgggaagcatttctcaccaatttcttaaagaaatcagtttgctagttgccaaccctagcctcaagaatcaagataatgtttacttgttttatttatattagaaaaaaaaaacagaagaagaaatcattcccgcgcaaataaggacattattggtatttcgttgacttgcagcctataaaaagacccctagtaacggcctgatactgcatccgcttcttactcaaacactttatcctcaacctcaagtctctctttaaaacccaaaaatattccaacttcacgaacataaatcatcaactacattaaatcaatcgatttagatcggataatcatctccgtcccgatataatctgcgttttcagatattaatccgtgagtatcgcctctttacctatcgaaatctcgtgtattgatctgatctgtttggtttcaaggaaaaaataacgtaatcaagaaaattattgactaatgactaatcataattttgtttttgttaaaggcctgatcatagttttactctgtaattaatgtatcatgataatgtttgataaatgaatcaaaagtcttaaatcgcttcacgtgctattttaacttaccacaatgactaattctcgtggcatattcatcatttgtcagatctttaaagc

SEQ ID NO: 435 - DNA, 3000 bp, Arabidopsis thaliana
tgttttcggatcaatgcctaaactcgatcacagaaatgctgaactcccatttttactactttccccaaaatatgatgcaaaatacaatcaataattgttgactgaacgagaacttgtttagctaaaagtttctctaatgctaaagctcttatagacatggtgaaacaaatattttttatgaaaattaatacaaactaaaaagtaaataatactgtaataatatgcgccaacctctctcttttagcttttttttttcttttttcttgcaataaagttagtgtgctgtcgatttctatcgaaaatcaaattgtttgctttggcggtgtacggatttatgaaataaaatatagccatctagtgtgaatatccgatgggtccgatgcatgcttgaaaactaagattaaagaagtcaattgtctttgttacctagctgatgtaactatttgcagttttgcacactttagcttagcaaatatgtccctctcgaattagtttacgttttaaagttggttgctcgtaactggaattattttatgttttggttttggttcggttttatttggtctttgcaagtcaattgcttcattccagtcaattttgtttactacagtcgtcgcaattgtgtatatcagaacaccatgaatataaaggttcacttttgtatattttaaagtgattgatttatttttcttttactttaattatgtcggttttacattactaaaagcaatatgatactaatatgtataattgtttcgctatcatatttctcatataacctatacatcacataaagaaacggaacctactagccaatcctcagttgagcaccacttttacctattgctacttttggaacttcgacctctagtagagtactgctacattattattttttattttgacaactttttttttataaagaaaatgctgagtcaaaagtaccatcaactagtagctcgaccgacacctaaaaaatcttgtaatgccaaatctgacttgtttcatcaaaaatattcaacttgacacaatctaactcaaaccaaccttgtctttgacttgagcttagccacacatgaccacttgtatatcacaacgagagcgaaagctaaggttatgacagtaattggtatttgaaaatgacataactgtttacgttatattttttacattcctaaataaggacaacattatttcaacccgacacggaatccacgtggagaaacattatttctatcgtttcacaaataaaagagaaatagtatgaatacatcttttgcgtcaatcaaattcgtaaaattcactcatgtttacaaattcttctgattatttttcatgtctgattcgttttctttcgttagtgggaattgatgagcttttgtgtggcgttcgacgaaacgacattctttttataatttttctaaaataaatttagtttctttttagttattaaaacttaaaagcaaacacttgcatagtgtcttcggacattatcgtcctgtccaaacaacaacttcggacgttatcctttcaaaaggaaaaacacgcaaaaaggagcaatactgggtgatttcctaatcgtatgctaagacttttcaatacttcaatatgtgatcacgattcacgatgaatacgtaaagggaattcaaattcaattttgtaagttctaacatagatagtgatttgggtaattttgacaacgtaattttcaaatagaaggtttgcttaacttcactattgcgccattactcgttaaaaatctatttacaactcgcaactgcataatgagatgagataatattgtatggaagataaagagtactgaagtaaggatttaaaaatggattattcaaaactcatggagtatattttaatgttttagctggtcatcatcaactcgatttaagaaaactgaattcataaatttttagttgactacttgactggtgttcgttgactagttcacttatttaagtttttcttattaccagacctagaaagaaaaaaatgaaaaaaaaatcaccaaatgtccaaatgagatagcaatgtagtactagttaatagattgtttcttaagtcttatagatttgtatcaaagggcttcttgactgatacaagtttcttcctttaattcggtttataatagtattgatctaaaaccaaactacaaatacttacttaccactaaacttacttttcaaactttggcttgaagctaaacttgaagctaattctcacttaccactagacttgaagctacttttgaaactttggtctcacataactagagttgtaaaattagatgactagatgcctactctatatactttttaattatttttgctcataacaaaagtcgagtcaaaaacaactcgcacgtttatcatctttaattaactacttgattaatacttattaatcgtgtatacaaagagacgatgaaggaagatcagctcaaagttgacccttgcgttgaccaaaacatccgaagagcaaacaaagtccaattgaacaatgaacacaatctaacacaaactagtttggtttactttttagcctggcttgagttttaagctaccgaacaaaattagaagacttcgatttataccgatgggtctcgctttcgagagtatttgaaagtgacataaccgattacgtcatctttctcgtgtcattaatgcttacgtcatagctaataatttctaccgttcagaatatattttcttatatggtaattagagatatgaattgtttagtgttaaagtattgagattctcttgagcacttaaacagaaaaaaacaattccctaagaaaaataccttccttttttttgttttggaaaaagagattcaaagtcaatatacacagccaccgaacaaattactctatataaatccaatgaaagcagagtaaacatttatatagccatacaatttgtggctcgacgtaaataacgcgattggagtcgttagaggaaaataaagtttattttgtataca

SEQ ID NO: 436 - DNA, 3000 bp, Arabidopsis thaliana
atctctggggaaatcgcccaaacagtcgaatatctaaagaaagaattcgaaatgaaagacttaggcaagacaaagttctgtttgggattgcagcttgagtatgtagataaaggaatccttgtgcatcaaagggcatatacagagacaatactcaagagatttaatatggacaaggctcacccattgaccagcccaatgcaggtgaggagcctaggattggatagtgatccattcggtccaaagaaggacgatgaagaaattctcggtcctgaaatgccatatctcagtgccataggagcgttgatgtacctgtctagccacactagaccggacatatgttttgccgtgaacctcctctctagattcagttcttgtccgaccaagaggcactgggaaggaatcaagcatttgcttcgatacctacaagggacaattgattttggtttatattatactaaccataacaaagaaggtttagttggttttgctgatgcaggatatctttcagatccgcacaatggaaagtcacaaacgggttatgtgtttactcatggtggaaccgcgatatcctggagatcaatgaagcagaccatcacggccacttcctctaaccacgcggagatattggcaatgcacgaggccagccgcgagtgtgtgtggttgaggtcaatgactcaacacatacgagccgattgtggaatggtcgaagacaaggagccgaccatcatatacgaggacaacgcggcatgcattgctcagctcaaggaaggatacatcaagggagatcggacgaagcacattctgcccaagttcttcttcacgcatgacttacagaaggatggtgaagttaaggtggtgcaagtacgttcaagcgacaattcagccgatctattcaccaaggcattaccagcaacgacattgaggaagctcgcgcatcaggttgggatgcggaggcttaaggacttatagagatgaccaattcagggggagtaatgcgtgctgtactctttttcctcactatggttttgtcccgaaaagggttttcctagtaaggttttaatgaggcagcattcccctagcgtattactgagatcccgttggcatctacacggttatgtcatccaagggggagtgttgtaaaccacttgttggatggactccataaccgtggcccatgtctttggaggataggtccgtcagcccattggtgtgacggcccatcgaccagtcggcccatcagtccatcggtccatcggcccgtcggcctgtcggcccggtccatggagagaagccacagtcagtccggcccgtaggtccggcccatggagactatacttaggtcggtcatatacttaagtagttatgggcttttgtaacctagcccattagacatgtaacctcctcaagtatgtatatatatgtgatgtaacctcattatgaatcaataagaaacaagttagttcttcacagcatcaatcgtagaaaacaatctgagaaaacataacagaaaattatatcaattttttttcttaagtactattaaacttattttcatagttctatagtctctcaacttttgttttttgttttttcgtggttatattaacatctattacaacttgtttacgcattttgtttattccatatataggtcacagataatgcgtgtgcattaagttttcaaacaagtttattagttctactaatcaggatattaacaattcttttgcgtggtaggtttgtttaacctcttgtgagtttatggttaaaaaagttaatctttctctaccacttaacacttcttttgtgtggtaggtttgttttgactagaagttgtagaaatagaaaagttgtacagagattctcaatctgctattctcttgagtcgttgaaataaatttcaattctatgatcgatgtgtcatgtaaccgttccatgaatctggacacaatcacaaaaagaatccataagttatttggtgtattaattatccgttttttttttgttcacaatattgattatccgtttatagatatgtttccttttgatcaaaaacaaaaagatatgtttccataactatttcaattttttgttaggaattaggtaattttgttataatttttgattctttaacatataaatgaaagggattcaaacctacacaaccacaatctttaatgatacattactatgaataggatttagcatccccacatcttctcaaagattcaagaaagttattcaaaattcaacaaaataacaaagagaaagataataaatgcgaggacgtaactggtaaaatcacgaaactgcctgattcaccttcactattcagagtgtttccttataaatatctatcacacggcgcaaaacgaaacgctcaagccctcaagtttatcttcctcagccgtgtagttcaaatcccggcacaaaactctgtcgtcgcttccccgagaaaaggtaaacgaatctttcaccaacgattaaccgtttctaaatattaaatctggttatctttgatctgtcttttttttgattctatgaacaatttctgttactagtaatcacacattttcgggaggagtgttcttagatttattttcattttcaaacgaaatttgcgattgtgtgttttcgagttttcagatccgtagctttcttcgacgaaattatatatgtatgtatggcttccgattttgtcagtttgtgtctagaaaacgcgttatgtttttgtcatgatgcatgtaatggacattactttggctattgctcataaaataaatcgatgtttttcaattctgtttcttcgtggagtcacacatatatatatatggaggcttatctgtctaaatccgataattagtcgtagaaatatcgttgtgtagattttacttggcaaagaagtcatcttttgtcctttttctcagtaaatcaggtcaaaaattctcacattgttgaaaactcaggggtcacacttaaacttgtcgaaaccaaacaaca

SEQ ID NO: 437 - DNA, 3000 bp, Arabidopsis thaliana
ctacaggcttaggagatttctcaacctcaacaagacacatcctgcaatttccagcaatagataaacgagaatgataacaaaacctcgggatatcaactccagcgacctcacaagcctgaagaacagtgaatcctttagggactttgaccgcgtaaccatcgacaaagacctcgatcgcatcttcaggattcgagaagtggacgcgtgctccacctacagggtttctaggagggagaatctgtgtcggcggctcaggctcagagacagcagcggattcaggagattggagctctggttttgagacgattgtgcggaggaagaaattggaggtttgagattgaagaagacgtgaagctggtcgaattgttcgagaagctaagatgcctaaacccatggcgttgtggatctgtatcgtcttcttcttcttcttcgtcttctatgtgtgtatttctcgatcttgttgtgagaactcctgaagcatttgtgcgagagagaaggagacacgaatgagtgagttttgggctttatgggcttttattttggatattataattggcttatgaatgagtgagttttgggctttgtgggctttttcttttcaaactgaattaagttaattttgggagatatagtttaagagttttgatgatctttctctaattcacttaatgacattgagtttaaaacaatcttgcttctagttccatacaacatattagaacctctagcaaaataaacctctaatcaatcattagtcctagagacttttaggtcaatgtactaattgaacatttgtatatttcagataaagacaacttaaaatatggttataaatgatgacaattttaaacatctcaacgtcgtctatttaaataaaaggaaagaaaatattgtcaacacctatgctgcatcggttaaggtttacgtgtaagagttagtttattttcctcgtttgtttaggtttacgtgtaagcatcattatcagtgatattgttattaatctaacctttgcaatgacaaccaaaaaaaaaaaaaaatgaagtttcataagctttgatatatattatcttatcattacaggcagacatgataagtataatttaactcgtttaatttgatagttttagttataaatttacatagtaattcgttataattttaattatgggtttgaatggttacggcggttcgggcggacaaaaccatcaacggatcagactgttttttatttaccattaatcaattatagtgcacagtggtccggacaaaaaaaaaagaagaaaaccgcaacagatcatctgtgaatcatccacgaactatttttacatataaataaacttggtccacagcggtttattgtccgcctcaaaataaggtagattaaaccgcatacaaagtataccgctttgtccactgcatccattcaaaacttataaagttataagttatagctaataaatatgacactttttcaaattgttatagatcactttaagagtgattacattcctctcttgtttttttttgtcaaacagagtgattacattcctttctttttttttgtcaaacagggtgattacattccttctttttttttttttgtcaaaacagagtgattacattccaaggcaaagaaacataagggagaaccactaactacaataaaaattgttgggttaatggcaaaagaaaaaaaagaattagtggttcttctatgaaaaagaattgcatccaatggaaagaggatgtgaccgagttgataagatatgaaacacaacatatatagctttttgttatcaaactatttatcgtctcgtatttgttctaatctaaaccgaaatactaatattttaaggaaatactttgcgaaaaataaataaaaattctcacctttattcaatcaaagccaaaaatgaaaaaaaaaaatagaagcaagacaatcatattcatacaactcgataaggtagtacctctaaagtgcaaaacgaaaacaagaaatatctctgctatctcattctcgtcaactaggaaactctgcataatctctcttttacacaatgcaaagaataaggtgaagatgaactgattatctctagcgtactatgaaagtcaatatttagatgcaaattaggtgatttttattgtcgatattcttctttttctggacacgtcctcatattcgtgtatatttaatttcttctcttggttttatacaaagccgaccatttggaaaatttaaaactaaaaatctcaaaacctgatgtaaattttgattttactttaaacagaaatcctacgttaaacatataggaaatgctgttacacacccattaatgtctataactagtacatcaatttacaacagatttattgtcttaaaaaaaaataactcccccacttaccccgtgaatgttcaagtacactagtccagattaacttaaattcgattatgctagaaatgattcacaaaaaccggtttagggaatcatcatccagatttggagcatcgtaatcttttggtaaatttttattagccgttcgtacaattcaattccaaattttaatttagatgagattttttatattaaaaaaacaatgatatatgttcgacaatcgacatgttctgatgtcctatataaattcggtccttctagacaaaaccttacgttatacacttcaactaataaagagtccaaaccaaacaaaaaaaaaacagtagtttctcgacagaaacaaaatcaatatagctttaacatcacgagaaagaagaactaaagaagaccaaacaaaaaataatttggaaaaaaacagagaagcagctctcgtgatcttcccgccttttctcttcaacttgtaaaacattacaagatctatcttctaccaaaaagacgaagtttcgagtgtcagattcaagagttgaatcgggtattaaactctgtttttctagatctttgtgtcgaagagatcgccggagatttcatttaaccgattcttgaaaac

SEQ ID NO: 438 - DNA, 3000 bp, Arabidopsis thaliana
ggcaaaccatcgccgaagaagcccctccacttagtgtgaaccgttgtagatcggagagacttcggcaataaactgtcttctcaatcatttaaacccaaacaacgcattttaaaaccaaaatgcattctcttcaatcaaatcttactttacataaaaatatgttttcagtaataaaacgtttagatatttaaaatccctactataagaatacgaagattaaaaaatctatgaatgtgtttttttcagaaaaaaaaaagtcattgatatcttaacaacagttaagtatattttttataactctccaaaattgtaagcggcaaaaattatctatatataaaaaaaatactcaagtgggatatatgtgtttcgtttccttaatactagtaagtttacataaatgccaaccgtatatgttttataagagcaagagggatccgaatctagatatatattcatgaacatgtgagcatgaaaagtaaaccttgttgtagtgaaaaagacgtttagtatattcaagactaatttttggtttgtacgaaacactcaaaaaatttcatctatttctttacaaacacttgaaagtgaaaactatccccaacacatgcaaagaagtacagttttctgctcgttctatagaagcaatataaccatttcttaaatttcaaaaaataaacatcgttagtatttgcttctgagtcagcaaaactcttttatggtttatcaataacttaatttcttttgtagttttattgattgatgacaaagaaaacttcattagtaaatattataaaggatccataagaattattaaatgagtgaaaaaacaaaagatgactttatcagattccttaaaacaatatttttaaaaaaaaatggaacaagtagcaaaatccttaaacaaaaatgcaaaaataattagaaacttataaaggattgactaagcattaagattccgaaagagagacggcgaaaatggacgaatattgagagatgtttaaacacagttgcatctatctctatttctgtatttaagttgtaatcttcgtaacattcacaatggactatgtcataaacgaaacatgtaaaactgttatcctgattatttggaagacatgtgtgcatggttgtaatctttttaccttattatagttctttccattggaaattatagaaaatctataatgtaataacgaaaatcataatgttaatgttactagtctccaaaaaaacgttagagcatttccacttgaaagtttcactaataaaaaataaagaaaagagagtgagaagagaattttttaatttttgagaagtttttatatatcacatctttacatatataactggttcaattttcttgtataatttaaaattttagttatagaactaaaccatatttaaaatactagtataatattaattagagatttgagtgtgtttttcaccagtagagatattttacaatagtcaacaaaatacgcatgcactaaaaatattatatctaaattaatatttatgtggaaaccaaataatattaattatatgcgcatagtatactctatattttgtaaattaaaaacgaccgttttggtagtaacaaatttcatataagaaaatctgtatttttattagatcttccattctattcgaagatttagttttatcctttataaataacaataacttatttttcgaagttttatattgatgagaaaaagaaaaaaaaaatcaatagataattttttatattatagtaatacattaaaataaagagttaatttgcaaactagtcacttttttaaacttaattagaaaagtagtcactttattattcataatttgcaaaatagttacttttcactgtttgattcgtacacttagattgtacatcacttttagtgtacaaatatatataaaaatacacagcgtacactttacatttgtatactaaaagtgatgtacaatccaagtgtacgaatcaaactgtgaaaagtgactattttgcaaattataaatagtaaagtgactactttcttaattaagtttgaaaaagtgactattttgccaacacaccctaaaataaaatattgagtgaaaaacaaaagttgactttatcagattcctcttttccttttcggtgtatccttttcagctaagttatgctataaaaaaaccaactacaaaaaaattaacaactaagcaaaattcattaacaaaaatacacaaaaagatcatgattacaaagctaatgagataaaacttataaagtcgtgactaagcattaagtatccaacagagagaaaaagagagagacctgaaaaaaatgacgactgatagatgtactgctccatctttctctatttaagtcgtaatcttctagtcaatatcgatccaacttctctctctctctcgcacactattctttgtttttgtcttcttcttctccttcgcctgcaatttctacgaatcatcctctctcgtcgttcttctttacatgtcggctaattctgggcctataactatttcaatgtccgacttcgtgatctagtgagatcagaatcacttgcgaattcttcaggtactctcttgttgtttcgtttaatctcttcacaatgccttgatttctagggtataattatggtttttgaccagacaatttaaggtttttctcgagaattgtagtttttttgtatatatttattcttgtgtaattgggatcgtatcttggtgcaactctctatatgcatgtatgtgttatagtggaatcttctctgttaaaaaataatcttttgagaatctaagaatttatataaacttggagtactattttgatttggattatgattcttaattggattctaagaatataagaattctaaagatcgaagctttttttgtttatcaacataaagatcgaagcttgattgttttttttaataggggttttgaagaagtttctctactcttctgggacgtgggaacaaggtttagtctgcaagg

SEQ ID NO: 439 - DNA, 3000 bp, Arabidopsis thaliana
cggttgagtatctctggcgtatgggctcatgatgtcgcttggagtctggcgagtgcagctgaagtgacaaggatgccaactgtgacatcaactctccttgaggccataaaagaaagcaggtttaagggtctgagtggtaactttcagttggatgatatgaagttgttatcagacaagtttgagattgtgaatatgataggatcaggtgagagaagggtaggattctggaattctaatggtagtttcagcaatagaagacaattatcttctactcatgacaatctggagaccataatttggcccggtgggtctgctcaaagtccgaaagggagaagtctaagagagagcggtagaaaaaagcttagggttcttgttacatctagcaatagattcccaagactgatgaaagtggagactgatccaataacacatgagataacaattgtcgaagggttctgtatagaagtctttcaggcatccattgcacctttcaactatgaagtggagtacatacgttggctcaatggaactaactacaccaagcttgcatatgcacttcatagccaggtactaagcatggctcgattttacaattgcaagtacttttaaaatttgcgtagactgtgtgtgggaactgacttaattccattgataatttttgttgcatcccttagaaagacaaatatgatgctgctgtgggagatattacaattacttccgatagatcgatgtatgttgattttacgttgccatacactgaaatgggtcttggaattgtagcagcaaaggagagaagtatgtgggtgttcttccaacctctaacaccaaacctttggataacaagtgcagctttctttgtcttgacgggtattatagtttggttgatagaaagagctgagaacaaagagttccaaggatcttggcctcaacagattggagttgtgatttggtttggcttctctacccttgtttatgctcatcgtaagtaccttttcacattcttatataccaatttggccataagagaagagattgtagtgatgcttaccttttgttgcttactctgtgtgacaggggagaagctacaacacaacttatcaagatttgtagttacagtttgggtatttgcggtgctcatattggttacaagttacactgcaacattgacatcaatgatgacggtgcaacaaatacgattcaacgccaatgaagattatgtgggtcacctctcgggatccctcatcgcaaatgcggccctcaccaattccagcctcagagcaatgagattattgggtctcaatacttcagaagattatgctcaagctttgatgaataaaagtgtctcatatattgttagtgagttgccatacctgaaaatcctccttggcgagaatcctggacattttctcatggtcaagacacaatctaccaccaatggttttggcttcgtatgtatccttcttctgcatcatcagttgctttactcttgattttacttgttgaaaaagaaatgtttggtttgttatactatgttccagatgttccagaaggggtccgagttggcgcctaatgtgtcccgggagattgcgaagctgaggacaagcgagaggctaaacgagatggagagaagatggtttgataaacagcttccatacacaaccgatgatacatcaaatcctataaccctatatagattccgtggtttgtttatgatcaccggagtttcattcgctttcgctcttgcagtacttctcattctttggctccgagaaagatgggaaatccttgtgaattcggtcaatatatacttctcacaacgacttagacatttcaggatcctcttcacaagaactatccatcctagtcccctcggcctcgataaccccattggcgagaatgcggttcaaatggctcaacgtaacagacgataggaaatgagtaacatagagagaaaacaattgttgtgatgtggtacgtctctgactctgaccttggagcagcaaagaagatcctccagtgatccactagctcctgatccaagccggcttacgtctgaaagtataaatgattgttataccaattttgtaaattatagtgtgatcatattcgcaaccacttttgtaaatagcaaaaaggtattggtaatatattgagttaaaatttaacacatttagtttgagtattttttggagaatatgatacttttgcaaagaaaaaaatactttaattcttcattttataaaccttaaaaaatgtaccaaactttaatcagtatgtaaaagactcgtgcatttcgtttgttggtatttgtgtttaatttcttccatcaatttatttgagatgagacgactttcaccatttttctctgcttctagatttatatctttgactgtctaaattgtcaaatcccttacactaagtacttttgttgatttgttcttgtcaacacaagttaatacaaccccaacaaatatggagtttttaaccaaaaaaaaaacaaatatggagttctacgtgtaaaaatttcagattaaaacacatttgttcctacgaccgttgacaaatgtttttttttttttaagacaaatgatttttttcttttgctaaaattggttagttgacaaaattttatcctatagaatccttttcgaatttattccgtatttttacctttttactttcttcaccaaacattttgatagatttagtcagattctcttaaataatgaaatgatttgagagacaaaagagtagccaaactcgatagcccataccgaattttacgttgactaatgtaatttttcttaaaatcatgatgtcatcatcttaaactttgaatttttcttcaaatatagtacgtatgttaatttttaaaattggaataattagacagatgaaaaacaaaacacggcatgggtttatataacaacaaaataaaataatgactaaaagcagcaaacgtggggtttctcctttctctctagttggaaagttttttta

SEQ ID NO: 440 - DNA, 3000 bp, Arabidopsis thaliana
cttttaccgaggcttcgaatcggagttgtaaatataacatcaagaatgttgtgaccatcactggtaactataggaaagtctcctccaagagggccttcattttcaacagaagctcttctccacaccttttccaccaagtaaaatacaatgactcaaacaaggcttgacacaatcgatagaaccaaaagcccgagaaagcatttatgaaagaagcagattcacacctctgcatcgcctagatacaagtcatctatctcctcagctatggccaaccaattaagctgcaatcaaagttcaaggaataaaagttttgaatcatatcaccaagggattaaaacgaagttcatcagtagaaatttacttacagattgaactaaaacagggatagaaccttcaagaccggctttgtattgttcttcctttatcatgaagactgcctcatcagctacttttacaatagactgtattgtaaaatctctcttttgtcagcccaaagctaagcaatgagtattcaaagactgcaaaaagtacacgaaactgcatacaccttttgtttcagaatatagtcatcttcctgtgaacttctccgccgtccaataactgcaataagcgtattctcttctacagcatcagcatcatgaaatgcaaaatcaatctacaaaagtgtcacactgcaaacattacccctagatgcagaaatagatcaaaccgctttagaaaacacagagaagcagctacctgaacaccatcccggtaatattccaaggggattccatactttgctgcttcactcgcacttcgagcagacctgaaaaagggtcaggacaaatcatcatgaagcctatcaaaactcaactcgtaacataaaagattgaatatagagagatcaacaactgaacaaacaaaaagattgatactttatttggagtcatagaagataaccagcagcagaatcagaatcaaaagactcacattggtacaccaacaacaaaatcattatcgaagaactaatgaatagggaaattcaacaactgaacaaacaaaagattgattttttattggattcatagtagataaacatcagagagagaagcaaaagacttacattggtacaccaacaacattatgtaaagaaccagaaccaagttgttgacccaaataacgtatagcaaaatctgaagcttctccagatcctaaaccaataatcatcccactctttacataattatccacctgaaaacattaccagacaaaagttttgtaatcaagtatcaatctttcttcaattttatgaattttcaacacaatttcaaacaatacccatttgaaattgagtttcaaggattcaattttcccgatttaacccttacagtgtgatgagctgctctgagaagaggagaaacctccggagaaagactggcgcaaactggaaaacgtttgaaattacgacggcgcgtgaaaaccacggacgacgagagtgaaaatggagttgatgctgtcgcagtaaccattttttttgtgtgggaagaacgatttgagtcactgagtcgtgactcggtggtttttaccgctcttatctcccgatcagttttgtggtgcatgtggagtacgaactacgacgatattacacgaccattttctttttggagaattacgaaaataggctaaattatatatattttgttccaaaaaaaatgataaaatatatattaaatatttattttcatataattttataattttaaagcaacacataaattactaagttccaaatattatttttgaatttttaaacctaaattttaaattctaactatatccttaaattttattttatggtctttgagctaatccgtttttttttaatctaatgttaaattatattagaaaaaaaacatcggtttttacaacaagtacgacaaaatttgaatttgagaaaaaactgaaatttgaaaaattaaataaatttttaacttctagaggcaaaccacatttagagtcctctatgatatctcctatctcctaaagtctgataaaggaaagagtgtttcaggtttgcttatcaatccaacgaattagtcgagctgtctgtcgtattagaattctccccatgtcttctaccattttgttctcgccaaatggtgtagactgacactacatatcacatttgtgacgtattaaaactatatatcacatttatgattacgataaacagtacctatcaattttacgatacagttctctgcaacattaaaatccacaatggacggttatgcatatacgatatattttgatgaaaatgtttttctcaaacggttctacaaatacgacattctctagatgaacatgttctccatgaaaacgaataactctacgtgccacattctacaacctttcattaagtatacatccactaattggcaagaatctacactttttgggaatcaaaaccctatcttgtatcattttggatatcttattagtattgacgatccaacgaggaaaaaaataaataattgaaagaaaacaaaaaggagagtcatttaagtttgatcgcacttatgagtgttccttgcttcctttctcctctactttaagcacatgtgggaaccaaattcttcgtaaccactcaatttggctcacaatttttcaatatccaataaaaaacagtttcatatattttctcgtgagattattcagttcttcctaatatctatctatctctatattacatatatacaatattatataaatacgcactcttctttcaccgacctccttacaccaaaaaggtgtcaattccacttgttcaccatgaatatgatttaatgggttcttcttcttttgcagctttctttcttttccttaaattatcattgttttaggtggggttttaagtgctttcatgactcattcattctctgtataaaacctagtggaaagtgttaaatcaaaaacccttttttcccactttcttaatttagaagggagacgaaaaaa

SEQ ID NO: 441 - DNA, 3000 bp, Arabidopsis thaliana
cgaacaattattttgtgcgattagtttgaaaggaatagttgacgaacatataattagaaagtcaaaatataacacattaaccaaacaaaaaatagtttttaatttaatttagtagctaattatatatattggtctcagaacgagtgaatgattcgtttgaaacacgttatgaatttggttggtggacaaatttttatcgatgtggtattttttagcaaataaaattggaattgagctatatattgtgaaaaataaaaagagtgattatttagtaactagaggacttgcaatgtccctattacgatgacaattcttagagatatatatgaaagaaaacaatgcatggtcaatggcgatcatatatgaagctagctatgtactgtcgcttttctttcctttaaaaaaaaaatcgcataatccagtctttgcgggctaacaccgataacattaaaagttatttattaatccactcctcaaatttgattcgtcagtagtttgatttataataatgataaatttgttaggaatttcgatgtatcggcatatcgctatggacagtcattattgtgcgtagtcgtgtttaaccttttttgtagtgttttgcatctcatacgtagtacggtagtagttgtgtttttccctaagaatcgaaattcgaatcattcatctcttaaatgatttacgcacaaaaatacctgtaatttcatttgtttccttagttgattttagtacgtggtgattcattatgtatttatgttcgaacgattggaaaacccccatcttttagcatatatacaactagatgagcattcaaatagttccacagttcgaaaaaagggaaaaattagctaagagaatttcttctataatatttaacaaaatcttctaacatctcgcctatagaatttcgaagttttatgattacaatttacaaatagtttgaaacagttatgtttatgggtagacaccgctcaactacgaaaaaaatataatagtagcatatcaaccaaaaaagaaaaagtatcatggtacataatatatacatgtatgcatatgaattggctaatatctattaatccatatgatggcaggcctagatttattataataataatatttttttttgatatcgtgaccaaagcataacataatggagatttcgaagtccaaaccataatacttaacggggtcgtacgtactaaaccaaatatgttttcaaacatttttgtcaaaaaaaaattatatatatttactttcctattttaggggtgtcattttcatctagctcttcttcaaactaggtcgtctgcccatatgggtgagtatatatatgtgtttagtaagtttcattttcctttgatgaaaaggtcaattcaactatgttcgaatatgttactagatcagtgcatgtatggaactgtcttacatgatctaattagactaaaagctgtcctccattagaaattcacaccaaatgacgtgtgtttatatattgattaagattaccggtcaaattgaaatattaatatattcgtttatataattctttagaaaaaatgaagaaaactcactactacgcactgagaaaaaaacgatatcatcaacatgaacttcaggcaaattggttcctttttatcttttttgtttttttgtttttaccgtcgtctgaggttaattttacttgtcaataattatttgtattgctatatatccacacattcaaacttaagttgggctgaaattaaaataccttcatgataactcttagtacgtaagacatatacatatattttctttaacaaaaaaaaagaaatatacatatattttgcagagaataaaattcactccctcgtatcaaatatagatattgatacaaagcttacaaaacgaactttatttgtaaatcaaatggtgcttgtcgacgttgtcgtctttgagcctattgattagttgtccgcgagattcagtaaacatttgaattaatatatgcatttttttgggagatgggtaaaacaatagtcaaacagaaatcaagatataatcataacataatgatattttagatatttgttctatatcgttttcatctgaaagatcctgatgagaatttaagaaaatggaatggaattgaaaaaataaaaggattcaaaggtgtaaatgtaaatggaacttaatttttttaattatttactgaaacaaactaagaagcttacctaaataggaaagcaacgaacaagttaagaagcacttgtggctagtggttacggtatggacaatgttacatcacattatccttacgaaagattctttctgactattttataaaagtcaaaagtcaattttcaaaattccgcgtaagcgtaacggttttaattattaagttatggtttggtcaacgtaggccagcttcaacaaaatctaaaccaaattcggatactttattatttcagttttttcgttaatgcaaatgtcaagtaattgcaagagttgaaaatagaaagcgaaataatcaaataccccgaacaaacactcttttgttgaaaacgaatatctataatgtacaaattaagattgttcaatccaataaaagatttagttctttatcaaaataaatttttatgagagttcaataatcatcgcagaaacttattatataatttcagattgctaaatccaatatgagaatgtaatcgtttctaaaaatagttaactcttatccaataataattattatgtagacaaagatattaggtgccatattaaaggagaaaaggcaactattggaaaaggtcgtcgggtggtgtctacgcgctatcgcagaaaaaagtgaccatgattggttacttatttcgctcctatatatataagacgtatttcgtcccatttcgaaaactcacatcaagtttcttcaattcattaaatcacttctcaattagctcttacgaaattcttttcattactaaaaaaatttacaaacaaaagtctcttgtaataagctaa

SEQ ID NO: 442 - DNA, 3000 bp, Arabidopsis thaliana
cttctattcttgaggaatatgacaaaacagagattagtatcaactgtggtgaaaaaagtaaagaactaaattgtttctatgaatggcttcacctttttttttacagtgattgtggagtccatcttggtaagtaacagctaagcaaagcaagtgtgggagaaatgaaaccatataacattaaaaacggtgaaggtgtaagaagagtttgacccctcttttgagcatttaagttaaatcagtttttggcctttatgaaatttgatcctcatagtacaaataataatactcattgtgggtctcatgaatggagatatattaggatttattagaattgtacacatcgttaatgcctccaagctttgttttcttttagggactctctttggattttctcatgtgggtctttgtactaccattcatcctacacgtgtgagtactgtttctctataataatatcttttgttttgattagtaattggattagcttacacttaggtgggtgagaatagttgagaagaaagagaacatggattcacttctctttcactcgaatattacttatgttgttagaaaatggggtcaaagaacttattagagcttaataagaagtgcttaggtggttttgttgaaaggttaaaaaaggtggggatgtttcttatagcaccaaacttttagctttactttgaatgagcctgattttgtcaggtatacttccccatgtattcatttgtctcttacttcataagtcacccatgtgatgtgaaattattatatagaatgtatctatatgtgtatattagtttggaaacttctctcatttaaattagacacaccactatacttgttaaagccttttttcatgatttggtttccatcttagataagatgacaaaaaatctctgctgtaacatcatacctttcgattagatttctcgtcccactttttttttggtttccaaaaagtttcaataattgaatacattttattggttgcagaattctctgctgttactgttttgtattttctagcatttattttacaattttgttcctaaccttctaacatagcaaattagcaatcataaacttttatgcatatatataagtgtaagacagtaaatcttgtatgtggaaagacattttccttcaaaatataagttcataaacgtcaagtcaattatggtcgactctctttagagtacatactacatagattagattcagtcggatttaatgtgtacttaactttttaacttgcaggtcttgcatgacaagagtcgtgtcacaagaccattaaagtcactgaagtttgtgtttatggtgcacattgacatcatgtagatggtattttgatgtaaacgaatgatatatttgtaatattacaacttcaaaggttacatctaaattttgagacttcgatgatttgttttttcttcgaatcactcctgcgactatgcatcagccaaatcccaaatgtgtgtcaacatctcgaaagcacaatcctcattcgttttttactgagtgtgtgtctttcccaagcaatatattcaaaaaaagtagaaagtaaatggcccatgcaggtttcgaacctgcgaccttcgcgttattagcacgacgctctaaccaactgagctaatgggccattttgcaatgacttgttttcttctaataatactattttcaaacttgtgattgcacagttgcacattctcgaggcttggagatgttattagtttaaaaaactctattaaggtgcataagtcaggttcaaatctaagaggtcaacacaatcctctaccattataccaaaaccacctaacactagtttttttcaactaatgcatgtagccctgccaatatataaccttgtttttaaccgtttttaagactgaaaatattcttaaaataataacaagttgacgacaaataaataattcaaattttagcgaagatcgcgttgttactattttaataaatattggactttcatttttttatgtaatcgtataattcaagatgccgccaaagagtggatcttattttccctcctactttttcatctagatttttcgtcataggaagaaagaacagagaaagagaagaacacttagcaaaattatttccaaggaaatgatataattaagctcccgctacacctacacaaagtttacgaggttgagagtatttaataaaatttataaagctcgacttaaataactcaaaaagagttgggaacctatttgcgacctatatatctcactaattactcatgatattattcttaacaatagacagatttagttccaaactaactacggaaacattgaaaaagaagtttagttgatttatctaacatgcatgaaataatatggacaaggatttgtactttgtagttgccatggtcgtgtcaacaacatagttcaaatcctattgagactatgcaaattcatttctggaactacattatatgtattcttttttatccgaaaaaaacactaaatatttcttaggtgaacaaaaaaaagagaagtagatagttccggagcagaacaaaacagttgaacgaattacaaaagaacgagaattctagatttgtttcaagaatcagttttgatgtgcttgcaacttttgcaaacatacaaacaaatatatctgccttaataacaaaagtggaatatgaatcggaaaaaatagtacacttttatggtaatataataatttgggttggtaataatctgcactagaattcaaataaattttcatctagttacctttgggtcataggagaacccaacaaccatctcacaaaattagttgcatctcacttgacctacttctcaagacccttgtaacacaagaaaactaaaaactctacaatgccctcttctcaaaaaattatatatctctgggaagtctcaaccatcttctctaactcctatctcaacacacatattttcccaaaatttggatcaaaaagttttccgatagaagaaattaaat

SEQ ID NO: 443 - DNA, 3000 bp, Arabidopsis thaliana
aaaaaaaagtggtcaatatcgtgtgcagggaaaaaaaagaaagtacaaaactcgagaaaaggactatagaatcatgaacgtggaccgatccaatgtgattatccttcgaaccaaagttaacttgatgaaagcttttttgaatggaaaaaagaacaataccttaaatattccacgttgacagtatacaaatgtaaatcctaatacaaaaacaacaacaaaaaaacgcgaacaaagtaaaaattcgtttttggttcattgagtttttcttaataaaaaaacgtcaaatcgtatccaaatttaaattcgattgtttacaatttctaatgtttaaaattcaaagaatattacactttagcatggtaacgaggatttattcagttaaactttgattttggctagtgacagtctttgtactatttactcactcattatgtcgacaaatatgctttattgaaaggtcaacagcaaacaacttaacgtctctttctccaaaacactaatccacctatatagttatcctataattacatctaaacatctaatcgaaatacacgtaatgtaaaatatgaagcgtgtcacggcacagtttctatcttataaaaatatctggttggttagaagaatgtaacatctacattgttttatttaatgtacgtaaaattaaatacattcacagatttgttttgttcatcacgtctttttctcttaaggtgtgtgtgtgtgtgtcattcgagttattgatattagaaaacaatctccactacacgaattcatcacgtaactgtacatgaaaacaatcttacccgattagtgaaagcaatgaattccaataaatatttatcccgatctataactaacatgaatttcatctaccacggaagaagttttccatatatagtttgtaacatttcatgttcttatgagtccaaccaaaaccaacgtccaaatgtctcaaaattggtaatgtagaatgtttatagaatttacctagttaattaagatttgtaagtatatgtttatatgctaacaaccatatcgaaaatacaagcataagattctgatttaaaatttataactggagttccatatatctgatggatggattaacaagaaaaagaaacggtggggattggttgaaccactccctgaaaaatttgcttcgttttgcagatgagaaaaaggttgtgacaacgtcaccaccatctctctctcccctatgtttttttctttctttattggaatatctctcataagcttctgaatcagatacccttttttttctttttcagcaaatcatagacctacgaatacgattttccttttttctttgtcgggacaaaactagaactttgttttcctcttaagaaagtgatattcagaaacaaacgctttctagttatggacttttaccaaaatactccaagattttacacattcttttttttcgtactataagagagttctttacacagaacacaaaattcattaaaatacatgctattttctttaaattctttattcatagttttgtagttatattacaggaggttaattaaaactaggaatgtaatatactactatataaaacaacattattatgagaatggaattataatgttagggatataataaatactatacattaaaaaaaatcaagatattctagaaaacagagacaatatttgtttttgaggaaaataacaaattttcaacagtcacgcctaataaaataatttaaattctgaaattcgaattaaacacggattaattacaatttttttcttgttttgataattacagctggatcataaatacattatatatatatatatttccagattttgtattgatttactttgcaaagcgctctctcacaagttaaaaactctcttttgttggtaatggcatacgtatatgttgataataacgtatctaccaattagactattttctagtataaaattgttaattaagttaattagattattgttgaagagagagagagaagacgtagaagtagaagaagaagaagcagacccgaaagtgcctgcactggttcagatttgcagagtcgctttgatatacaaaaacaaaaacgagtgagaaattttcagacacaagaaaacaaatctctgtctttctctaaaaccctttctctattttttctttttttgagtctcctgagaaaacaagagaaagaaaaagacagctgatagagagagagagagaaaaaagctgcattttttttgctttgtgctcttgcttcttgatctaaccattgccgacaaattctaggcgaatcaatcagtttcttcactcaaatgggtttatgttagtttgtcatgttatccacagaatctctggtttgattcctggtttgtctcctgattctctacttctccgacaaatctccactaaacctgtctgaaattttctcttcgttttggggttttccattgtgcttgacttgttgttgggttctgggatcttgtctcagcttttgtttttttacagctgtcaaattgcgtttgcgtgttcttcatcacctcctgcttaatccttatctatcttaatttaagaatcaattcatgatttcaaatagtcataagaaggcaaatgtgtttgaaataattggtgtttggtaaattcattttcctctctgggtttcgtaaagtcaacatctttgatagatttgcaattttaaaattttattgatttgctatcattcagattcgagtctgttgaccaattttgagtatgttttgtgtttaataatttttgtgtttaaaattatgtgacgagcttccgaaatttatgcttctttgtttcagtcttctctgccattttaattatgtttctgaaagatcaaagctttcgaaatttttactaatgggtttggttcatttttctacaggactatgagatatgaagcactaatctgattcttgaggaaataaagtgctggattttgttaaaagatcatagagaagttcttgtgga

SEQ ID NO: 444 - DNA, 3000 bp, Arabidopsis thaliana
gaggggttttgtattcctaatttgtatatataagttggattgattttctcgttaagattttctaaatattttgttcataatttcttatataaaaacaatatccaattgaaaaagaaaaataaaaagaaaataataaaagaagttctatatatttattttttattttttgtcatcaaactataaaaatactgaattaaataaaagtcgatacagaccaagtcagaaaataaataaaaaacagagccatgatcaaagacaaatgaaaactgctcagacgaaatcattaattggttagaattctcgtgtacttaacatttaaccattccccctgaaccggatcaggtttattaggctctcacacgtataccaaataaaactattttctcaaaaagttccttaatttatttaattatcatctctggtttcatccaagtgtaattattaaaattatacatataaacgttcaggggaaaaagaaaatattaatacactgagactataaatacacgtacagagacttgaacttgttttcttttcttgatcagttatcggaatcttttatttcttcttgatcagacgacgttgaatacagcgagacttggacttgtttcgatggagagagaggagccaattgcgaggaacgaggtggatcacgaaacgccaacgaaaccagatggtaaggttcttttctttttctatatttctgaggaatcatatataaccaaaagcacttcttctttgtgtttgttcatcgtgcagaatccgcctctgcatcatctccccgtaggtctgaggaaacgctaaatcagagtacccaaatcaaccaaacggtaaggtttccttctctgttggtattctcttaagtgatcatgaagaatcgtacaacgacttctttgtatttgttcatcatatgtagaatcttgaatcaccaattgttcaatcacaagaatcttccagcttcgaaaatgttttgtgtttgttccagagtcaaatataaccagccgcttgttttgtgtttgttcatctgcagggtccgagatcagtactacatcttcaatcacaagaatcgcatctcagcaattccacaaccacccatgcttcgtcgccttctgtcaatgtgactccaaagccagacttgtcttcattttctaatacaacagcgacgcaagaaccgtcaccttctgctggacttcaaattaggacgattgagaaagaccggtcaccgggctctgccttcccaagacataaaagactaccagttttcgatgaggtttgctcgggtgcggtgtttccatggtatggaccgcaagaaccagacttgccttcttcatctggaataggaaccatgtcagcaaacagtcacgatgatgtaagtacaacgttccttgtatgatggacctttttgtttcgaaaaccaacaactcacaacaataagatttactctttgtgtaatcatcctgcagcgtcgcgcctatgaattagcttatcctttaccaagcagagatatacaaagcaaaaaggagctgaggaatgctcacctcaaaactcccacagccactctcaccaacactactaccacaaccatccatggctccaggacatgatcaggatcactctgctttggatgaaaatcttcagtaaagtcgccaagggtcatttgtttccataaaaacttcatttaggtttgctttgctttgctttgctttgctttttctgaattccgtgatttttgcttctataagaaacctacatttgttggttaacccatcgtgatatttgcaatgctatgtaaaatgaattgcagaccaacaatatgaatcatgtattggttagaaaacccatgtgtgtagattaggttatttcatattgttttcattgaaaatattcggttccataaaattttgagctagtttatatataaagcagcaaaaccatgaaaatatccacaaagtatacgataatgatctaaatccaatctttcccaatttcaaattctttccattctgctttcttattacctttttaataaagtttcttgctaagcaagcaactataaaaaaatatcttgagaaaaaagcagacgtaggcaacataagactacacccaatcaaatatctacggagagagagacaataggcaagaggtttctctttgtgaaattagctagtggaaagattgttgaaacgattaaagcagagaataatactgtttcaaagttgtatcagattgagcagagattgtatggtatcataaacagggttgtcaatactttctatacgaagttgatcacaatttgggaaaattttaagcgtgcacaagattatccgtcgtatgggtgcactcactgttgctgtgtgttagttagaaaaattgatggatctatttgagggaaactttgtgaaaattttctattgggcctcaaccacaaatcattatgttgattccactaccagatgtggagaagactctcaccaagtcagatcttctccgcagaactatggtcataataatcaacggacacaactctggtcaaaaccaagcccttcttctcataaggcatttgctcagggttagaatcatgagaatattgttgtgaaagtgatcacttaagcaggtcaccggctaatcaggcacatttgcatcaagtatatcacatgctcttgcacaagtctctcttgagatcaaatctaacagcttgccactcagcaagatgaaagattcctactggaccaaagcggttccacaataataaaccaattgattttaccacatacttatctttagtcccggtatgggtcacctcatcccattcgtcgccacccaaatagagtccacacaaaacgaaccaaacaaaaaaagaaccaaaaaaaaggaaattcccatttcccacagaactataaccacgagcatgatctataaagctactacaacgtaccataaataaaataaatgagcatagatatttttcaagaaataagaataaagaaaattctactctta

SEQ ID NO: 445 - DNA, 3000 bp, Arabidopsis thaliana
tttttccaatattattgtttcggataaagaagcaagttctaatttccttgacgtgaattaacattaataaaccaaacaaagctatagcactaatagctctcaatcgaagcaatcctcaagactatctttcaaacactatgttgactcaagttcaaccaactgtaactgtctacaaatgcggtgagatacttaatgaaacattactttacatatttgtaatggcccttatttggtgattacataatgcaaaggatttagagccaaaaaagcagagagcatgtaatggagtgggaaatgaggtagagaatgaaacagacctggacaatcttggcgaggagaatctcggatacggaagtatttctcaaatgtaccagcccatgcatctctctttgtaaggaagtgagactttaggttgaagagtttcttcaccgttgcagggatagaagaatgctcaaattgtgaatgtggtgttggaccttcaggttcatgtatcactgcaacgaaatcaatcccacaccagtcttatcaaaatcacaaagacgggagactaatctacatgtactgatgtaaagcagattcaagtaagaaattagaatcaaaactaatggggttaacatgaacaaagtcatgtcactaagacatgaaattagttcaagtgaaatcatatgtaacattttaaacataaagctggagataaaatgttcaatactaaagatcaatataaactcaactatctgaaattagtaagagcgaaatgttcaacaatgacagaaatataacaaatcacataccagtgcccttctcaatccagggggagatcagaaaggtagggacccgaacacccaatcggtcaaacccaaagtaaaacggatcaggtccaatgataccatcagggttaggcacacctttaaccggcgtgggaacatggtcataaaacccaccgtgctcatcataagtaatgagcaaagccatctctttccactgtggactactccgtaacgtctcataaacttccttaacaaaccgttgacccgccgccacgtcatgcgacggatgatcatcattagccggaaaaagatcgatatcgaaatatctctgttccacgacagaataattcggaagcttcccaagcttagcgtcgagcttgaacttaagtgcatagctatggaatttcaccaaatgcttaagcctacgaagagacttgaagaagaacgtcgcagggatgttttggtaataaatcccaaaactgagtccgttctcatctaacgaatcaaagatcgtcttttgaggaaaccctttaacgagatctttcttcacgttgcttgagcatccatgagaagtagctgagtgaacgtagaaccgattcggttgagtcgaagttggtactgaagcgaaccatcgatcgaaaactccgaactcgttcgctaactcggtgtaaaccggtaagacttcgggtttgaacccgctcataacgttcttagccattccaggctccatactctctgattgctgtgcgaatccgttcattttcgggtcgccggatgtatcgttagacccgaatatctgttctcggatcgcttggaatgagtgacccggatccatgtctacgaagacggcgtcgtctgagacgaagatctttttggaatttggatcggagacgttgaggggatttgactctttgccggttaatccgtcgatttcgggtcgggtcgatttgagccaaccgaggatgtgatcgaaggagcgattctccatgactacaacgactatagtcttgattggtccttggatcttgtggggtttctgggagtttttgaattcaatggattgagatgaaattagtaagtagcagaagaggattacagtggttaacactcgccggaaagccatttttccggtgaccttagacccggaaaaaaaacgcggatgaccagtggagaagggtaaaaattcggcggagtgtctagggtttataagataaatggtgttgagagaggagcaaagggcattatttacttgaagaataacaatggaagagagattaccacagattttaagagagcaatgaagctgaaaaaagtcctctttggatctaacattccttttctaaacataaaaactatcttaaactacgtttgactttgggtcaggaaaaatcccaaaactagataccaagtcaaagaaacaaaatcctcgattaatcaaaggtaattgcattacattaacttgataattgcattacattaacttgataattgcattacattaacttgataattgcattacattgtgtttacttacatgcatggattttgcgtgttttgtcggatgacacgatattcacctaatatcacattcgtatataaatcatatacaacgtctctcttaaaagaagtggttatttaaattaaaaacttagggtcaccagatcagacagtacatactaattttactaaacctattcatctcttgacatttagagagacattaagtgatacggacaactaatactaactaagctaagggggattcaaaaccagagattttgatttttgccaaatcaatgttccacacttttgttggccaaagaaacagagaataaaattcgctgtcttccacttcaacttttgtttcaagtccagtaccagtaggatatctctactactctttttagcgtcaatttataataattgtctcgctgtttctttttctgcaatggagattctaatacacatcattcagatatctgaatgtctgagatccagagatctaactaagcaataatgttgctaatttattgttccacttttgtatgctcaaggtcccaaacaagagattaaaatacaaatttgtcaagcctaattattattataatcagtttttcttgttttctagtttaacacatgggactccactaccatatcaatatgtcataaattcatacataccaaagcaacaagcgtttcagtagaaaaatcataaagaaaaaaaagtaaagag

SEQ ID NO: 446 - DNA, 3000 bp, Arabidopsis thaliana
tcaacttaacgacctgccattctgtagcgtatagcataagcacacaaaccttgctttacacaattaaccaatgtcaaatcgaagtgttaagtgttctttatttgtattgcatgttatcgtcaaaataaccaggtgatttacttagtctttgctttacacattttcgtgaaccgaggtagtatatcttctgcccccacttgcctattcgtaatcttgacgtcattgaccaacgtgtcaacttaacgacctgccattctgtagcgtatagcataagcacacaaaccttgctttacacaattaaccaatgtcaaatcgaagtgttaagtgttctttatttgtattgcatgttatcgtcaaaataaccatgtgatttacttagtctttgctttacacatttccgtgaaccgaggtatagattcagtatatcttctgcccccacttgcctattcgtaatcttgacgtcattgaccaacgtgtcaacttatcgacctgccattttgtagcgtatagcataagcacacaaaccttgtgttaaaaagtgctacactaaagaaaagggtttacacatacaacaatatattacgttggaagctgtatatcctctgacgccgcattaaatgcgtctgatacgtatctccatctctctttgctcgcgctttttattgtcacatccgggaatttttctaataattttctcttatgttttctttccaagttgctccgatatgattattgtgattttaaaacatcacatgttgtttccgtagtacttgtgctgtttaccaaatcgtagtacttctgctggtcatagattcaaggtaaaagcccattcaccttgttgaataatcaatccagtacaatactcacccgaaaaagttaccagcccaatatcgtggtatatactccatttcaatactaatttttttgttttttaatgattatttttttaaaaaaaaaatgaaataaatcctttcatagtacatgctgctgcagttgtaaattgcatgtattttatgaaacgttcagtacaaacttagaaagttgtagtaatgaaagctctaaattgagatctacactcataaatagttcatgctttatttagtagtaactgcataagtaatgcatgctttttttttttgatacgttgtaatcattgccctacaatctctagctcccctacatctacaagtctgctgtcgggaatatggttttgccgcccatccgtagaggctatatcggatatttcgcatggtaaaaaaacgttatatacccaacttttctgggagaaggtcattctcttaataaggatgtcaaatttggtcattcagtaaattaacccttcaatatataacaatacggacgtaggaaattgaacataaaagcaaaaaaattgttgttgaagatgattttcgaaattttctttctcaaggtgccacactgccatgctgtgaatgttatcaatagattaggctaaaaccctacatcatatttttattcgttgcgcaaaactataatgaattcgatataagcaatgattataaagagcatttcaagaaatgctataaaaaataccgtagcatgattgggttttaatcattgctctatgcatgcttattcttaggccctcacgccctacatcattattctcatgttacattttcttggtaaaagcatctaaatctttttgtagtgacagaggaaagcatatatattctcgagaacaatattccaatttatataaatatcgtaagaaaaaaagagtccaagtaatttcaattagttcaatttaatgtgtattttttttctttgaaaattttaaaaaggtgagtaagaagaccactggaattgtgttttcaacatcaattcatgacctaaagcaaataaagccagagatttaggacatctccatccatgaaaaacccacaaagtttctcaaacaaaaaaaatattaatattatattataatttgattatttgattaaaaaagtatttttgttaaaaaattgaactaataataagatgaaaattgtcatgatgggttgtagagaatatctcagagtttctcaagtgagaaactttctacactctctctttcattttcattatttttatttttttaattgtgagaaattcttatgatatatccttaatagagatggttttagtgtggtttgattggctattttgatgttagtagagaagtttataaatcataattcgatttataaatgataacagtgaaaaatggatggaagtgtcaagttggtgtgggacttcacaattgggctgacgcacgcgcaccattcgcttccttccaaacacatcgattggatattacattaacaaaatggatcccactcgtttttataacataacacgtggatcccacttctgctccttcctccacaacttttgtttcgtcttcgctcaagcctcctttgagtcctttcatttagttctgatgttatttagaaattttctctgaattttgatttctaactttaggtttaaaagttactatagtataatagctaagagagtgaacatacgtagaagacttccttaaatagacaaaagttaatgcacgtaaatattacacgtcattgcacatcaaattttaccttgtttatagtagtagtattttgttttcccaatatttaaaccgtgatgatcttgtggctgggatttaaatgcacaaaaaaccacgaatttaaatgattatacaaataaggtcgatcttctcactttaattgccgtttgcactagacccaaaaagagatatactgtaaagaatagtatactactacattaatgataattgaaaatatataaagaaaagaataaacaacgaaaagtctccactctccattaccacacaccacctatacatatatgccatcacacttcctattcttcaccaaaaacaagctcaatattctcttctttcatttcactcgatcaagtttgagcttagcttttaaaaaaagagagaaacaaatc

SEQ ID NO: 447 - DNA, 3000 bp, Arabidopsis thaliana
tatcaatcaaaacctgggccattagtgtatcattgcggggcttgctggctgatttggcaggttcttcttgcttcagctgcctaaataccatctatcaagagaaataaaccattactccatttataaataaacatcataaatacaagcttttgcacaacatagaacttagaataccttaagagcaccggagacaaaactcgagacatctggtaaactcccttctttagcaagtactgacccaacaagacctaacgtaaaagcaagtgaattgaacattaagcatatgtactaaaattaatcgaaacagtaagacattaaagggtaaattcatcatctttggtgcattcacaacgaaattaaacataaactagtctccaataacgctgaataatctcccctaacacatacaagagagtaaaaactgttcctttgttcaatttctgattggtcgaagaaacagatgaaaaccaaaagtgaagcacactaaaaaaatatcaaaagacttgaaatttgagctgaagaagattcgatgattgaaagacagtgaagcaacagtgatcattataaaagggtttatcaaaaaccctaatttctcatcctctaaatgcaattccccatctacgaaacaaatgagaacccgagagaggagtacgagcaccgatcaattaatcactaaaaaagaaaacccccacaagagtactgacctgcaccgatgaggatggtgagcttcccgagaggaatagccatggaagacgaaaactcaatccggcgagcttgtacgacgaaggattaagatataagaagaagacgcatgagaagatctaagagagaattggtagaagagagcagcgggaaggtgccggcgttaaagatgatgcactcttgcgacgacggagatagagagagagagaaagagaggcggagaggagagagaatagagaatagagagactcaaaattgttttgtcgaagggacagtgttgtgttcctcaagtgacttgacatacaatacttttattttattaattttcttattgggcctagaaaaaggccttagaatatgctctaagaagatgcccatgaggcataaggttattgagatttgagactttgaccaattcgagataacaaaacaacttgagaggctgagagcagaccacacatgacattacaaaggcgtttttgctagagttataagcttcaagaagttgtcctagtaattaatagtttgtttcatctattccacatacatatgataggtcgcaaatgtattattaaccgtcgacgtcctgtgcctatctacctcataagatgctcgagtttcgatagatcttcttcatttttataccaccaaaaggaccaaatcttcaccggaaaaaaagcaatacaagtccgaaatagagtaacatgaatacatgataggaaaagtgtttccttccccaaaatatctaaacgagactctctttggactttttcgaagtgcctaatcaaacaaagacacatctcttttggcccaccttccgaaactaagacatattcaaacatacactcttcttttgaggttgttaccaccaacccaaaagaagaaagaatatgcaaaacctgatgcaaaatagcacagtttttcaactagctaaccaataaccatatactcttattttgaggttgttcttccgatatctctatcttcttagctctcttcttgtttttcttggaagtgtgggaagcagagatctcgtccctggtgagatgatcttcaaaggcttctatgatctggttgatgagctcacggttagacgaagaatcccatttagaccagtaacttgtgtagcaatcaaaacattgacagtcaagcagaggagctttatggcttctcttcttcttgcaagatacgacgttagtggtgttgagtgacctggtgattaagtaagcaagaacttccagatcttcggcggagagaaccgagactagaactagaatcgcactctggagaagcttaaagacagaaagagagtcatctccattcgaagaagaagaagatggaagaggaggagatgggtgcactttacctttcttcattactttcatggctgattttgaggaatctttcttttctagatagagagagagagagaagcagaggagagagttttctttgctgcgattattgtttctttccttaatggctttcgcagataagaggaaacagagtatagagccttttttcatgtttatgtatttcaccctcattaatcattattatgtctctcgctcatcatatacatgcatgattttttttttttttttaacaaattcaatcaattcacaaatgagctaaatcacaatagctccagcgaaaatgcatgatttttaaaatgcttctttcaatgatatagttttattgtaatggaaaaatatttagcaaatagattataaacttacatgagacaagtataaataattattataaacttattaagtttaagatcaaggcttttgtgcaatgtatcaatgaatgttagatgtgatatgatgaaagcaatgttttaaacacatacatagtcattgatcggaatgtgtgttattagaaatgcatgcctaagccgatagggttatctatgtttggtcttggacattatagccaaatttcgaatctaattcttccaatatatatttttttttttttgcttagggccactactagtattgcttatcaattttaagagctcatgaaaatgcaacaatatagtagttgcaaatccttgtttcaagagaaatcaaagggccacttgtgaattgaataataataatatttgcaaataacctttcactaaaccataccaacaaaaccacacagatttggcaaagacataacctttgggagacgtgaaaaggctcaaaatttgacaattgtccttacaaattcgctcattagtgcaattgtgagatttgtttgcatccaaatccaattcataactcacactcgtctcaaattcgaaaa

SEQ ID NO: 448 - DNA, 3000 bp, Arabidopsis thaliana
aaaacatgtatctcatgttcaggccacggtggtctgcgcaaagtccaatggtatccagctccgtatacgaagcggcggtcatgactatgaaggcctttcttacatgtcgtctgtgccatttgttattctcgatatgtacaatttgaggtctattactgttgacgtgtcaagcaagaaagcctggattcaagctggtgcgaccttgggagagctctacacaaacgtcaatgacgtaagccaaacactagctttcccggctggcgtttgcgctaccgtaggagctggtgggcacataagtggtggagggtatggaaatctaatgagaaaatacggaatcactgtggatcatgtcattgatgctcaaataattgatgtcaacggcaagctcttgaatcgagctaccatgggagaagatctcttttgggcaatccgtggcggtggcggtgggagttttggagttatcctctcttggaaaatcaacctcgtcgatgttccaaagatcgtgacagtatttaaggttaacaaaacactggaacaaggaggcactgatgttctctacaagtggcagcttgtcgctagcaaattccctgaaagtcttttcgtgagagcaatgcctcaggtagcaaatggaacaaaacgcggggagagaaccatcactgttgtattctatgctcagttcttgggtcgaaccgatgcgctgatggctataatgaaccaaaactggcctgaactagggctaaaacatgaagattgtcaagaaatgagctggcttaactcaacgttgttttgggcagattatccagccggtaccccgacgagcattcttctagatagaccgtcgagtccaggagattttttcaaaagtaaatcagattatgtcaaaaaaccaatccccaaagaaggattggagaagctttggaagacaatgttgaaattcaacaataatattgtgtggatgcaattcaacccttacggtggagtgatggaccggattccagcaacggccacagcgtttcctcacagaaaaggaaacttgttcaagattcaatactttacgacatggtttaacgcaaacgccacaatgagtagcctgagtcaaatgaaggagctttacgaggttgctgaaccgtacgtgtcaagtaacccgagagaggccttttttaattacagagatatcgatgttggaagcaatccgagtggtgagacaaacgtggatgaagctaagatctatggatccaagtatttcttggggaatttgaagagattgatggatgttaaagctaagtatgatcctgataatttcttcaaaaacgaacagagcattcctccggttcgtgtaatgtagtgatatttctgttttataagtttatttatcaagttcaataagctatgtgggcatgtgttatatagtctatactgtatgtaattttcataattgtttcatttgcattatcatcgtttattcattactgaataaaaaatcaaatttccttaaacatattagttgcaggtataaataaaaccatgcagggccgaccctaagtgttttcgggcgtacattaacatggtcctgccaaacaatgattcactgccctcttctccgcagggcgatactaatatgtggtaggttgacaaaaagaagatctattttaggtgataaaagggtaagcgattcatattaaaacccagcaattgtgcattttaattcgaactttcgttatgtgagcccacaagcacaagtttgcgttcacaaatactataaaaacaaattcgacctcaaaattttgtgtttattaagtagtttagtggtaaaggctattcggagtaaccttcagcactcaggttcaaatgtcaagaaaagctaatttttcataatatatatatatatatatatatatatatatatatatatatatatatatattttttactaaaacaaatctgaaatttaaattattatcataaagctacttctttattttagttacttgtagtcttaaaatacttagggacggtttatattaagtcacataaaaatcatgaatcattctattatatactaaaagtataaaccagaatttatcagtagtatcatagttcatcaagaatatcacatttcatatcaaactttcagtatatatacgaatgtctgataaataagttagaaaaaaaaactaaaataattgtgaagcataacaattcacaaatcaaaattaacttgaaaaacatctaattaaaacaaaacaaaaaaaaaagatagttacatgcgtaaataggtttaagtctacataaattaatataacagtagacgcagacacaatttaatggtggtctgatttaacgatgacggataggatcgacatttctactataagaaaagtcaatcgcacttttaaattaaaagataagttatgtatcaaaatttctcggccatcttaaaataatgggaaaataataatatagtcattagtattttacaacaacgtagccttataaaatttgaattcaacgaggggggacaaagaaaacaaaggattcaaagagaagagagaggaaaattcagtgcattctacaaatacatttggcataaaattcaacaatacttaatcgcaattatttcaattagtagatagctaggtttggtcaaaatatgaatgaagtcttaccttaggtttccatttataaaatctcgtggtcacttaaaaaatctctgtattcaactacctaaaatgatcatttgaaataaagaagttcagttgatgcgactcaccccctgatctaaattatgaaagtcatttcccctgtactatacgtattacgtacgttgtaatttcataactttgttcaaaataaacagctacttgacgaaaagtcaaaccaaattcaaaagtacaccgatatggaaaaaatggtcaagattgtcaagttgaaattattgtctccatatatattggtattctataaattacaaagtagaggcataatgaaccaaacagcaaa

SEQ ID NO: 449 - DNA, 3000 bp, Arabidopsis thaliana
tggactttttaaatacaaattattctttaatctgctcaatagataaatatactaaagcaaagtatgttatatttaataacatacatcaaacaccgaatagtttttttttgttctggctgatgatgaaagattcaaaatgattctacaaaaaattaacaaaaataataagaaataggttttaacccgcggtataccgcggagataatttattttttaaagttaatatatataaaagtttgcaaattgtatttatattttataatttacaattgttattaagtaatgtcctgccaaatccgtcccgtaaaaaaactcatttattttattaatgttgatcttatttataatatgtttatgaaccattgtctaaatattttttaattttgtagtaattaaatgctatcaaatatctctgtggtttgatgattataatcgaattgttatactaatgcagaaaagcaatatcaaaaatgataattttgtagtaattaaataatattaaatattttggaacttttattttagtaactaaacgtgtagttaacatggaaagattttacgaagattgttaaatgtcaaatatttaattcgaagattttctttctaattatcaaaaacaaacattaattcagtggcagccattgtaaataagtctcaactacaagatttattttacaaaatagctccaaaaatgtatatgtagattggttatatagaaacaaattacttgatagaatacatataaatgtttttaaaataaaatttaattaagtaaataaataaagactataaacagaaacatagaggatatatcaaaattgtgttaaaaaaaaaaagagagaatatatcaaaataaaaatgtttttgattttgccattactatcattttgtgatcgcaaaaccacttaaatgaaactctggccgacatgtcagcacgacggagttggtctcctcctccaccaggcacatttatcgtagccataacaaatgcggcaattctattggctaatcatgcttttcccctcccccctataaagctcttccctagaaaataacctcaattacttaatagcctaccattgttattttcaatagtacaatgctcctaaactaaaaaaattagtatgttatctcccacaaaacctagttacatctggtcatcgaatttttcatagaatacaattatggactgaagaaaagatgaattccataaataaaatttgagaagtttatacagctataaatggagaatctaccctcctcagttctctagtagttcaacttgctttcgatattaaaaatctttgaacgagatggtttgataaagctcgatttcataattttcaaacccgtagttcaacacatgggaatttccaaagtccaaaacccatcacttgctactttcaccaactcatgattatgttttacatcattaacagtttcaatatgtttactttgttcattttttacagtttaaccattcattcatttagatatctttcttagcagcataaatcaaaacgccacaatcacttatgaatcaaaacacgttttattaataaaaacatcataactcaaccatgccacatagtcaacaaggaatatgaagaacggtcaacataactctaagaacattcctcacaacaaacacacatcaaaatcaactatgaatttgaaatcaagataaaaaaaaaaaagaaacatcgtaacataatctatgaccacttggaactattagattttggtcccgaatattaatatcaaacataacaaataactatttatttctaattagtcaggtttcactagaacaccggtatcaattaaaaaaaaaacaatatgcacaatatttttcttatacaatatggaaattgaaatgttaatagaaaattaaagtttaattaataatcttgattagtactatataatataaattaatctgcagactgcaccatcattcttgctacatgtcatgttcatatcaaaagcaaagcaaaaaagctgacaaaaaagtcaaatatattttttactaagaaaattcctcatttctttattgttttgttttcttataaaccgaggaatttccgccatctctctttctctctttcatcgtcctcaccggaacgcgcctactctctttccacatcgtacgtttcctctctctaaattcttcaactttaaaggtgataaaaattgaatctttcccacaacccacaagaaaattcgaatcctttctctctttctatctcttagtcacgctttcgatcagcaatctcctcgaattctggttggttccgtctctgttttctgtacacaaagccctgctgctgttgatacacgtgagccgccattaatgcccctttgttttcttcttccaggtacgttttcttcaaaagggcctttttttttttttttttttttttttggcgttttctttcttcttccgtttctgcttcttctgagaattcttcttcacattacctttgtcttctaggattttctatttcctctaaaatcaggatctttcagctgaatttcactttgattttatttaggttagtcttcattttcattttagatatttatgtttctttttctgagttttttgcattgtcatttgtcatgggaccgacattgctccgacaagcgtttcccaatctggggttgatttttatatgtttccaagtgttttaattcaaataaggtttccggcaaattttgaaacttttcatcttcaaattgctgcttttgggaaaaagtttcagcatttggttcttgtcaattcttatcaatgctatcttaactcttctttgtgcatttctgtttgagttctgtggctaaggttgtttttggagataatttaatctcgagaaatttctcagttttgtttttgggattttgtagaatattaagtcaaagtttgctcttttgcagctgatttaggaagttggtgatcaaattacatctagtgtttgtttccgccagctgaagtgaatcaaa

SEQ ID NO: 450 - DNA, 3000 bp, Arabidopsis thaliana
gcgaacaaagtcgttgtaaatttccacgtttatgcggacataaatcaaaccggtgggtccggtccgaccaatgctagatctcttacgcatgtggtcacaagatcttgatccagtaaaaaaataaaaaataaataaatctaaagagtaaataacttcgttgtaataaataaattctgctttcaattaaaggaaagtccaaatacggaactaattcacccacatcaaaagtggccagagcctatgtaatccggtttaaacaaatttacatccaatcgaaatcgttttaaccaaaagtaaatcaaaatataaaccataagaaaatttaatcaggtttttttttttgggtgcaataattaggtgttgtttacttatgtatagacaaattttattcgaaatcaaaccaagttagagtaaaataaactgatcacaaccgagagctttacaaaaatctttttataaaagtaattttgtttaaaattggatccaaggagaattattcgaaattagacgaatctttggttttctatacttaaaaattattttcgaaaatcatcacattcaatccaaaattgaaccaaaaaccggttgaacttctttgctttgaaagaaaattatatttaacaaattaattgtacaaatttctatttcctaaattatgtacaattaagatacttgaacatcatcaacaaaaaagaaagataagattagtgattagttaataccgttatagtggtccatctgagtggtcagagtgctaaagacaggccaataactcatatccccaaaaccattcaaacttcacatccaataggcgaaacagagctcatacatattttaactataaagtttactacatgtaattaaatctgcgtaatatacatgacttcttgaattaattgaataccacgatattattttaaaaagaaaacaattatcttttagacatactgtatctatactttcctgtaattcaatctcacctttaaatcaatcaacattattctcatttatctaattatattatgtatatattagctaacattttgttgtgtacaaagtatactaatcgtaaggatctttgtttaaaggtaagtgatacaaaagtatacgaaatcacaaaaccttaatcaaccaacataaaatcatgagaagcgaggagaattcatttttttgtgactctttgtcatggggaggttgcatgaattaaattattatcccatgcatattgttagatcatgccttgattaacgaagattgtcacgccttttttatatacgcacatatgcatgtggagtatttaaaatagttggcaaacaatctccaaggtcaccaaatcaccgaatttagtgataattcttctccaacgtaacactataatagacggtatactttttctttgggtgtttgtgaacattgttatgtcataaaaaaaaatattattttttttatatctttgattaagttttatattcaaattgttggttttcaaataaatgacaagtatactatcaatattttttgaatgttttcgtttctgtaatatcaaatttttaatcaaattaatataaaatgataatgtgcacaaatgttttcaaataaatatcacattagttaaaattaaaaatacattataaaacttaattaaacattaaaaacatttaattacaacatttaaaccaaacaaacataaaaaccaaatgcaataaggtaaatttaaaattcagcagttctaaattaattagtatttatcaaactattaaaaataactattattaagtattagtatttaataataaaaattttgtttttggtgtgagatttggtgtttatggttggagataaaaaaaatctgaacaccaaaacaccaaatttgatgttaaaatttggtgttttggtgtcaatggttggagttgctcttaaaccgattttgtttactattggttcaaatgtcttttggtttgaaaaaaagatcaagcaccaataaattattacatcaaatataattaattttttaagatgtatctttaaacattaagttaaatttagcacatttttttttgttataacatctcaaaagaattaggttatgatacgaaataaatcaatattttaaaacaaattagaaattggtatacaataaatttgctaagtacaattactatcatatgatatcacaaataaaactaataaattatttagtaatgattacattagtgattaaaataactttgtttacatcttcataatggttttatagaaggtaaattaactataaaaaatttggtcgtatccgcaaatatacagaaacaatccaaatatagaaaacacaatattataaaaataaaaaataggtggagggtttacattggggttttgagagaggcgcttctctgctgcaaattgcctttactgtgtttctctcttcccctttataaaaccgcttccgtcgtcaatggcgtgagcctaaacaagaaagaaaaaccattcttctctcttttcgtttttttcattctctctctctctactccatcgttttcacacttttctcgccgccctttatccttatccgataaacccacaaataaagacagactcttttgttctttaaacagagattgtaaatccagagccgccggaaaatacaaccgccggtttactctcaggtctctctttcactctctgtttctatctctggttcatactcttgtgtcttctgggtttgatacaaatgataatgcaacagcttttgctctatttgaatactgatttgaaccaataagtttttattttttaatctttttggtcatcccctgtttctgattctgcgataaagagatgttaaatctagaaaaatccaaattctctctctgttaagcatttctcaaaagcttcacgctttctcagtttctggtttctagattgttgttgactgattttggttggtgatatctctgcaggattagttgatattattcgattttaaaaatcagtaggaagaag

SEQ ID NO: 451 - DNA, 3000 bp, Arabidopsis thaliana
gcagaaatatgggaaaatcttgccaaaaacatatacaaaactaagttctcaacaaactggtctactattttaacttctgtctctactacttggcgaaacagaacagagagttttcttgctagatacatcttccaggaaaccatacacaccatatggcatgagagaaatggtagaagacatggggaacgttcgaattcagcgactcatctaatccggtggctcgacaaacaaatgaggaatcaaatttccacaatcgcagcaagcggagactatcgatatgataaggctctccaactatagtttcaatcaagatcatgagcttttttacaaaaaattttctactctttcaatcatatgttgcacttgatgtataaacgtttatttactttttaaatataatttaacattaaattcaaaaaaaaaaaaaatattatgatttttgattggtaactggtaaccccatttaacttataaaatcacaaaaaaaatatttatgcatgacaacctttgccgagtcgcataatggttaaagttaagttaaaacatctattaaaatgattaagtgatagcattattcgtaagttacgagtatacgacaaatcatatttgatatgataacgttctttattattaattagcatcggtgccactttcttgtcaaatatatttatcttctctctttatcaatcataaaattaatgatatcttaaagtctttgataactgaccaaaacataaagattttttcttttgtttttgaattttgagcactatgtaaacatgatacattatgttatatatacaatatgtagtacaaaatatatttattaatgaaataaaattgtttgtgatttcattgatgaattcttaatttgttaaaaaaaatcatgtgaaattgaatatggttgatagtttgaatatgttgacacttgacattaataaatttgtatatatattattttatgaaaaatagatttgtacaatttaattagttatgaacttttgattgtttgttttactattttttttatcgacaacatatataatatgcaaatttgaatcatatgactatgatacatcgacggcattaacataaaccataacgctagaaatcttaaagtattctaatagcctaatttggtttttattagaattaaaaccctacataatcctggatgtgcgtaacgtagtagttgagctctattcttatacaccagtaaagtaaataaataaaaagaacagaaaatttcatgagcatgcagtagaaaaatcagtcgaatgttataaaaatagggttacagctaagttcgacgaggtgctatttcattggatatcacgaaacttgatcgtcaatatgttttctttttgtcttttttgtttttgggtcaacagatgtataaatgtatttgtatatagcttacatgaagaacacttggttagctaaaaagaaaagctaaaagaaacaaaagaggaggcagctaaaaaacgaaaaaagagccagcattatagatgagcctcttcgtgagcaagtgagtcgtttattgtaagatttgcctcttctaatttttttctttaaaaccttataattgtatttaaacaaatatcttcataagaaaaaatatcaaatagatatcaatgtacttttctttgaaataggatttcgctattaatccttattttaacattcatataactgaccaattatattggtatacagaaaaaaagaattgtatttgtttttttcacattttagtaaatctcatttttttctttctaaattatgattaatatgaaaattaaaatagaaagtgacatgtccttattttaactccttttatttcattcattggtttaatgttatttacctaaggatactaatcattggtttttgaaagataacaataaaaattcattccaaacatgtggtgcaattatatataattacaaagtggatagagtatagaactacaaaatggatagagtttagttataacaactaatttaaaaaagtgttcatttgatagagtctaaaatcaccacttacattgactaaccccaaaaatttgtcctaaacactaatcaatccgaagattataaaatgtcgacaaagaaaataaaataaaataggagtctatgagtcgatggaacttatccaactaaactttaataagaatgaaccaaactcaattttgtaataatatttaaaatacgtttttactctctcccagaatatcccatctctctgattccaattcctcctctctctctttcgtctctctacttcgaattgattgttttaaccgccggtgatcggagcaaactctctgacggtgaccgccggtgatcattttttgtgaacttcacttttggtaagcagctttgacttttgttcataatccttcacttttccttttcaattttgctttttcctctgatctgatcttagttattaagctgttgaatcgcatgatcctttcttctctgattgattatttctaatccttcatgggttttatgacgaatcgtgtcttagggattggttttttctgggttgggtttctaaatttgttggtctaagaacagtgaaattgttgtttcagtgatctcagattctacacttctagtgattgaactgttatggaaaattacaaaatatgtggctctgctttcatttaaattcaatcatcatcatctctgctacttgatgatcaggtcaccttctctgtgttttgtaatctccataacgtaagagtttgtttgatattgcaattttgaataagatgattagcatccaatccaatagctgatgttgaaacctaactctgtaaagactttaaatttgttttctctggctttgtgctcgttgaagggtaacctaaagatttgacctttttgatccaacacttctctttttgtactgtaggtgtataaagcatagttcgttgggaacttttttttacagctttggagtaactacctttcatggtttttggttccaaca

SEQ ID NO: 452 - DNA, 3000 bp, Arabidopsis thaliana
gagattttttcaatttaaaattcccttatgaatatctagctcatgaccgaaatcaggcactaatttagtaagacaatgtaattggtgttgtgagcaaaggagtctctcgaagcttttttacacaagaaaataaattatataatttttgtttcaatttctttcatataactataaaatattccaacggtctctctgggataaaatcgcttatatacttggaaagtggttttagtaaaaatatataatgtgttattgttgggtggtaactaaaaatttctcgaatcggttagttgcttaacagttatctaaaattcaacaatggtctacaagatttggaaatttttaaaattgacaaaaacctcaaaaaatttcaaagacctttccgaaacaaatcaaatcaaattaaattttagagtattcggattagatcaaattaaatttaaattctaatcaaaaaccagtaatcacatttcaataaaacatggttatcggttaacgagatatggtatttcaaataaatatgtcgaattacatagattctaataaattgtgatgtttagtgaattaataataattttctcgattaacaaacaaaaaatatcaaaagtttaagattcaatcatgtgacgaatagaatttggataaatcgtatattctactgttatatttattattattattatataaaaatgcatgaagtatatgattaataacgataagcgaaaaaaaatattttacacagattgttacgactcctactgaatagttaacatttttcacatacttcaaaaaaatatagtttaacagaaacttttttcatatttttatcttttttgtaatacaaatattaaaacaaaatgtttataataaactgtattatgttacatatataaataatatctttaaaaatttgctcatttgagataatctagtaaaatggttgaaaaagtaatatttttatgttagaaaaagtaaaatctaaaaaagctacatggcagactactatacgtttgcaattataaaattaggagagccaaccgacatgaaagagcatttatgtaaataacaatataattgtggaatatgggcacattgttttcatttgttaattaaaaaagacataaaaggtcacctgataaaaaaactctaatacctacgcttttgtttgtgttcgatctaaagtacacattttcgttctattttatacaatcttttggcaaaagtcgcataaactaaaaactcatagaagctacaaatgttttcatttgtattttctttttttaactaggaaatgtcgtaccaaaattcatcataactaagctttattaatttaggcatattagctgctactctcgatgactcgatcaatcgattgtctgaactccaagacataattgcagccgagttatcaacctttgttacaaatgttttcttcatcaattcatcaaatgaagtgacataaaataccgacatgtctctttattcagctaggtactctcattgatttcatgtactttcttaagtcgcacccgtcaattcctcttatagtatgtgtgtttcaaacagtatacacgatatatagagagagaaaagaacagaagatgacatggagaacaaacaactttatgcggcttctcttctttaaaccattgcactctgaagatacagaacaacgacaagctaagaggatatgttgcgagaaatgttttcaactagatattccaaaatcacatacaaatagtctttagactctattttttacttcattttatattctctaatttttttcaaattcaaactcaacacataaggatgaaagatgtgtataatgtaaccatattttatgctgaacaaatttaacattcatacaaaaaaaagaaataaatagctacttatttatattttcttttttatgtgaaataaattaaatttgataaagcaatttacagtagtgaattaccattttactcttttgtacttgtgtcgttctactttctcgttctcatcaaatagctaaccatcaaaaatctctagttatactgtattttctaaacttacaacattagttttaacttttaacaaacagaagttggataaacagaaaaaaaaaggattcaaaataatttttaaataaaggattatcaattatcatttaagtgcacattaatacccgtttaataatttattcatgtaattattaattgttctaacgtctgaaaacataattgccaactgccaagttcttctacacacatgccacatccttggagccttaacgaccttccacgaggaacttcgtccaatcttattatattactaacccttttgaatctgccttttcgttaaaatatttttataatctatgaaaacgatttaaatttatctactgaacaaacaaaaatttgtcttgatattttttaattctaccgttttgttttcactttaactattaaattttcttctacattttgttattgtcaaccaaatacggtccataatcgaaatctacggaacatatatacacaaaagaaaaaataaattgtgaacatgaattcaagttatactatcagttttaaaaagtttaaaattcatgaactataaataaaaataaatctttgcaatcttctctagatacatcaagaacttctctaaagctatatttgacttttcatttcgttagttacatcacccatggaaaaaagccaaaggtttaaattttcatatctgaaaagtaaaacttatataaaaatgcaattaatagaagaacaatatcgaaaaaagaaaagttattcataattaatttgttccggatttacccttcgcgctacgcctatttaatcaaacgttgtggtagccttcgtagaaactactcacaagccaaagaccaaagtaactaaaaagtttacaagtccatcaaactgttcttttacttctcaaacactcaagaaaacttttcagttatcttctataacctaccccaatactttttctttgctcaaa

SEQ ID NO: 453 - DNA, 3000 bp, Arabidopsis thaliana
aaatacctggatgatcgatcttgtgttacaaattggttgtatttagagggttgttgttcttccaatatttctagagaagactttagatatacggaaatgccttatgtgatatcgacggaaaacaaaaagcttactgtatacttcattaaaaattcagcaatcattaaaaataaaataaattaaagaataagttgtgactgtacgatctttttatttgacaattttttttttttcggtttcaatttcataaacagataatttgataggtgttcagaaaaaaagagaaaatttgattttattcttcttaattcgtttttataataataataaaaattaaaacaagaaaaaataacacgtaaaaagagtattgttagttgttattcacgcgctttgttcttattaaaataaaaaaccgttggattattcttctttttctttactttctttcctaattttctagggattcattagaaaaattcttttaggttttacaatctttgaaagagagaagatagtgcgtgcgcgcgcgcgacgccatggatgggaagagtaataatcatcatgatctttttgcgaatgagaacgaagagaaagaggtattcttgagtcttgaaccctaattttgttggaaagaatgatgtgcgatgtggtgcgatactttctctctcaagtaagaccattgatcgagggagattttcgcaaatcccagcgtcaccttcacttggtgaaaggggaaaaatcgaagatcctcgtaaaattgatgctcagaaattagattctccacaagcaaattggtgtagtcattgtagaaaaaacgttatcatgaccgaaggcgaaaacacatatgataaaccatttagttctgattgttctgatttaaactcaaacatagttctgattgtttatcgtgaaacgaaaaaacataggataaaacaatggtcaaaatagtgccgactattcatactaacatggttcatttcttgtattgtggggactccttatgtcaaaacaatgttacgaggttcttcttgatgacactattgaatccaagaattatgaaaagcttcttgatctttcaatatcacgtgctcagagacaaatattgtaagatatgattagatgcggataactattatcatagacaagtggaaagattatgattcacatgtatatattatagatcatgaatttgatcatcaagatatagatttttcaaaagtaatttggtgtgttttagaaagaatgatcacataaagcgcacttataatggtccaacaacttgatatgctaactgataaggataatgggtgaatgaattggtaaatacgatctgccaaaacaacaacaacaaaaaccaaaaatgtcaaaaacagaaagacttactttattatatatgtaacctgagtgagttgatgaaaaattctgatcctagaacgtaaggagagtatacaggtagtttctgtatctcgctatggcatgattcacccaaaataggctgaaacaggtcgctaacaattcatcccttatcacttgaggtgatgcttcaccagcttcttgttcaaagagagacttccacaggttagaaatgttaaagactcgatggtctccctcacaaaaccattaattagcctttgtaacatcctctgcagacctcagtttatcctctagcttcatcagcacttgcttgtactttgcaataagccaacgataatagtcgatcatcaaaataagagctatcatttcttctgagaactaaaacatgatatctattaagacaaactgtcggcccatttgtcggcccattcacaacagagattttgaattttctctttgaaaccctcaagtgtgtttttcttaggcttggtcgatctttagccgtcttcaacatcaaaatcaatggaggaagaagaagcgagacaagtggtgatcgacaatgatctgaagaagaagatcaaggaaacggtgaagaagatcctgaaacggtcgagtttacttgagattacagagattaaggcccgagaagaagcttcatctgagttgaatctcgatctttcgcgagatccgtacaaaatcatcgtcagagaagccgtcgatagtttcatcgagaaggcgattatgacaatcgatactgagatgggaaagcttcatactcagattgtagaagatgttgatggagaagtaaccgagaatgccacgaagacgactacgaagaagaaaaagaagaagaaggcaaagaagaaggtggaagaagaagagtcatcacctgcttaggtaaattttatcatctcagataaatttcatctttgctcaggtttttgtgtaatttcaacgatgaatgatgtctttagttgaaattagtgttttagccattgatactacacttcaagtcaaagtgtatcagactctgtaacatgctccatcaatagttatatgttttgttacttaaaaaattgatgattgtctaattcattaggacatttaatttgccaaagaaaaacttggttttggtgaaattgtgatactcaaaagattcaagtatatcaaaatgaaacctctttttccaatgctatatattctctttgtgttatgaaatgcattatttttgtatcgacccttcaaatgataatgacatttgcatatctttcttcggtagagtttgacatatttgcatttaggagagacgacaattagaagattgaattgtcaagaatatgattgactcaccacgtagattacactgaagccacaagcacactttgtggtggtcgtcattctaattcttattatgatcgtttcacaaatattcatggactcgaataaatccacaattgtatactaagcattattctaggaaggatacaaattgatgcaaaaaatatttagataagagaatgctcttagaccacacaaaatgctacccatcattttcttgttttcttcatatagtaaacacaaaaacatatacaaagaaaactgaacaaaatttgaagagttattaaa

SEQ ID NO: 454 - DNA, 3000 bp, Arabidopsis thaliana
acaaaaaactcatatgtgatactttcaaaaaaacttttattttcgtcaatattctacctactcgtaataagaattgggttattgatcaaatttttgtcgaccgaattgattaaaaataaataaatatatatatatatatatatatatatatatataaaccggagatcaaattaatagttcggatatacttccatggatgcaaaaataaagtatcaaacttcatttatcatgtagaatatatattaaaggatatgtaagatacaatcatttataatttgtttcggtttcacacttaatatagttgagccgcgttaatcattgttctcacttctcactgtttttttgtttcccccaaagaaaacttctcactgatttacacgtacgctatgtataaatccacgaatttgttttttttttatttaactataccaattattgacacgtgcttaaattcggtaaaagtcgcatactttaaaatatttttctttccttttacattttaaaatatttgaggcgaagttttcacacttatatattatggtgacatgttggcttgtatagtaattgtatggttctatacagatgctgagcacatgtcaaaaacaatataaatacaagtacaaaattttgatagaagcaattcgaaagatagcaatacaaataaaaatgctactagataaaagtaggacagtttaaagaaataaaaatttatcaaaaattttgatatagagtaagtatcaataatttgggaaaaaaaaatctagctccacttcaccacctttgtatagccacttcactttgtacaacccaatattaggtatttgtactactcttttaatataaactatgcaatgcttctatttgcacacttttgtataattcctatgattggttacatacaaggccttacaatcattaccactactagtttatatatgtaactaatcaaaaccataatcattatatttgattgtctatttgttttgtttggcacaactatttactaacaaattaaaccaaatcttattatatttaatctccatgtggtcgaaaaattaaatatagttttttatattatcaattgtgatgagacccctctatcacatttttcttgatttgtttgtagctattgtagaagaagaaaacaactacttaaaaaaaaaaaaaaaaaaaaactttcagaagtgataatctttgtccgaaagagattgatagatgactttgataatgagaaacaaatacacaaaaaaaagcatttacaaaaagtacaaaaacgagaatcatatatatatatatatatatatatatactgaaaagaaaaagagaattacatatttaatcatacaaaaagaaattaaaaacaagaaaaagtgaatgattgttgggattatttctcgttaatatgaaaatgtctaccatgaaatgatatgtgaactaacgactttaattcactaaagaagagggtatcccacatcaatgataagtttggcatcaacaatcatgcacaattgcacatcacgcctctgagtaggcgcatgagtgtgtgaatgaggaaatatgaaaaggatgagagagcaaaaagatttcacacagatcacagatggaattcgaatcattcgaccaagaaatatgtgaggaattcgaatcacaggtcttacgcagtcaacggaccatccttttttctatattaatttctaacttctaactataacattcaaaaagtccaaaatatgtgaggaatgattaatgtgaacactggtaggtttatttactgtttttccatttatttacattgacctagtgtaatggtatcatactatcatctgcaatctgtagtgccacgtcgccccaaaaataatgattaccacatccacatgctcttctactaattaaccgttccaaaaaattatctagtatcgtcactaattaatagtataaagtaagattatcatatacgtttatcaaaaaaagaggtgtgagactatcatacttttattaatagccaggaagagaaagaagaaaacgttcaacgtactaacactattcagtatccacacatgtgcgggaatatatgaataaataatagtatcatttaccattttttataacaagatcatcttactttagctctaacccctttttgtttctagattgtctacgaatataaaataaaaatatagtattaaaattttatacgtggctaaacttacattttattgtattatatcacgttaaagctaagtgactaacgaattatatatacgatataataataataatttgtggttaattttaaaattttgttaataaatgttctataaaaattaatatatattgataaatatgaaatttattaaaacaaatttatcaaaaatttcatggttacgtacaaaaaatatataatcaccaattcaccattttgtttatatatgttcttattagattttgatattttgataggtaaaaaataaataaatactggggtaataatttacgaaaagtttttaagtgttagatagtacaccttccatttaaaattaattgtcgtttaaagttttttcacgagtataactaatacgaaacaaaaaaagtaatagatactatcttttcttttcttcttttacctctttacacataaattttggcaagatttgggtatttggtatggtaatagactaatagtagaaatttgtgctcgataaaactttcgatatctaacggcaggaattcgaagtaaaatccaacggcggaaatataataataccaaaacaggggggggctatataattgtataaccctaattagaataacgcatcccactactcattctctcgagagcatcctacagagtaaaacgtgtagagagagactcacttttttttctggagagagagacacactttcaaataaataattgaacttgtttaaaatttgtcttctcgtgaggtggtgaaacgtggcaatattagattggttttttagtttggttggctggagaaa

SEQ ID NO: 455 - DNA, 3000 bp, Arabidopsis thaliana
agttttgaacctttgaaccagcgagctgtagctcagttaaaagaaaatgagtagaggacttgaagaagataaaatgatgcggaaggagaagctagcaagaatgtcgtgacagagtggtggatttaatggatttttatgtaatgtttaaaacttatatcttatgttttatgttggtatccagataattgacaattgttatgtgtgctatttatttcaataaattaatttttaataaatttattgttttcttaccgtttttcctaattataatttaatttaatgcaaaattagtattaatgtgatacttttgaatcattttgtaaaccgtcgttaaaatatataaaaagtgacgctagtatatttaaagtgaagcaaaataagttaacgtcggccactaatatgtcaattttgtaaatgactttaagttaattaatgtcggttaataagtgacgttaaggtaaaaataaactgacgttaatagtcttctttttttaagtgatactagattttgacccgtggtataccgcggggttagtttttaataaaattagttatataaaatgtatatatagatatttgttttattaatattgtttgctttgtttagtgtttaggataatgtatatatagattttaattgttatatctatgatttcatccgtactatatcggttcgtattactatcgatccaaatccatcatactatctaatcctgcacagtaaaattaaacatatctaatggatttcacttgtggtataccgtctcgtaatactatcgaccaaacccgtcctaccactaactccgttcagtaaaattagatattattttgttatttttgttttaataatactttaatttaaaaaatatttaattcaaatcaatttaaaagttttctttcaaatggttatttaattgttgtaaagtttatatattataatattataaacacgtcctaccatctagtcctactatctaatcatgttcgatgaaattaattttttatttttttaataatatttttattaaaagatttataatttaaatcaatttaaagttttctttcaaaatgattatttaatttttaaatatttttaactattttggcaaaaataattaggacatagaataagagcatattcctttgaataagatttgctttgattttgtagttaatttttgcattgaataaaccagtggcagccattgtaaataagttctaactccaagatttatttcacaaaatggctgcaaaaatgtatatgtagatatatatatatatgtatattcattttatgttttcaatataaatattgttttagaacattgtttataaatatagatctgaaaaagtatgttcaaatgtagatttttagtcaaattatgaaaatatcaataagtaataaattaaattttgcatttttgtatatggatatatattagatacaaatcttacttttttataaaaaataaccaaatacaaaagatgcgtggctcaatcagtcataaaaaaaacaattactatatgattgatacattatacatatatgacaactgatacacaccttataaatgctctatttatgtttgactataatatacaatctaccataacacaatctagtaaattgttagtatcatcctcgtgtcaccacctcaatttaaattcacatactacatggtatctcatatttatttattttggttatgtttctaatataaatagtgttcttaagaacactgtctacacattcatatctgtaaaccaaaaaaatacgcacaaaggtaaatttcaattttttttcttcatcatatgatgattttatatttttttcaaaatatattcaattttatgatgtcaatataaatagtgttttaaaacactgtttatacatatataaatctgaataaaaggtgcgcacaaaggtaaaatttcaatttttcttcatcacaagatgattttataacttttctcaatatatattcattttgtacacaaagatctgaaaaaaaacaggtaatgcacaaaggtaaaaatttcaatttttcttatcaatagttgattttataattgtttcttaatgaaatttgggtaatttcaaatataatcacatgtatccgttaccacaaaccctaaaagaaacccaaaagcatctaacggtgaaaacactgaaaagccacgtgtacgtttcagatcacgcacagcaataaaaaaatatgaaaaaataaaaacggaagtgcctattggcttacaagttacaagtatcaagtcgtctttttattcaagtttcgcggcaacgcctctcttctcttctctctctctctcttctctctaattcaatccaaaatcctcttttatctctctctcgctctcgctctctctttaaacctctcttcgaatatttgtcaccgatctcgaacaaggtttttgagctttctcttctccgagtcggtttctgtgttgtttcttcgtcgattcttattgagctccgtgattggtgagtagatctgttgatttgatttagggttttttaaaggttttaaacagaagtaattgggattgtttttgaacttcactttatcggattcttctggggaaatttgggatttgtggattccggttcggcgatgcgatttttgatttcgaagttctttcaaaaaggaaaaattctttgaaatttgaattctaacttttgaatttatgtttgggtttcgttgaaacgagtattggtatttgaatctggggttttttttttttttttttgaattctcaaagttgatgattctcgattcgtgattctttgttttctttattgattgatgcttcgaatttttcagagatttgttagtaaagtttataaatttcttttctggtgaaaaattgaatctgagatttttgtgaaagagagcaatttaatgtcgtatcttggtcagatcagttttcatggtttccttaatttgatctttcgttggaatttttctaggcagagaaaacagttat

SEQ ID NO: 456 - DNA, 3000 bp, Arabidopsis thaliana
tcatcgtttttattattcagatattcgtcaatgcaatggttttaaatctatttaagacgagtttttttgaagtactaattgatggagatctttggtgaatcacaaactcacaatcattctctatggatttccatgaatttactaacaattaacgctgatgaatatgatgaaaaagtatataagttatgatgatccaaatgtaacagaaaggttagtatatagctttaactaatcttctaaactttatttttattatttaagaaaaccgacagaattacagggcttaatgaattttattgcatgtgccaaaaaacataaatacctattataaagaaacacttgtgatataataacacgattattgacgatataatataaacgaattacttggaataagtgtggaacgaagttgaatgataacaataatctatcaaacgttgactatcttttctgacacttcggccagcattagtttgagcatctagttgctggtgataagaattaagtgttgcttatgaaaagcgatcaatgagactcttttacttcttctttttttttggacacaacaatgagactctattacttaacttagacaatttagatgaaaattttgtttttgttgttttcaattggatgatcagaacttaataatgttaacaaaagacatataacgccaatatgaatataagagccacataattattacaaataacgggcaaacaattttttcagaaaaaatgagatgaaatatcatcagaatacagtagtccatggaaaataaaccgatcacgtcttcaaattgatcacttaaagaaacccaaattccaaccacggtaagatggtgctttcttcactttaggttcaggctttttaaccagcttctgattttgtgccggttctccatccggcccaaccgcgataatgtcaacaaattcatacaccttcttaagtttcttcgtcatttcaaacttatcaaattctccattcacctttagtttacctttttccttcacgtctatcaaagtaactcctacaacaacaaacattattgcttaatttgtattaagcctaaatagattcaattacttatattatatatagacattgtttgtacatattataatatacctggaaagtcacatacaactttcatagctcttcgtttgattctttcctcaaaaacttccaacttgaatacaactttctcctgcaaagatttagatttgaagctttagacagttcattgtgtataagtagtacctttagttttctaagattttaagtaactaaaagaaaagacataccggcattttcggaaagtatagaaagtttgatgattgaggagatatgatgtaaaggaatatgaaatcaacctcgtagcttgctcattaacctttgtttcgccccatatatatacacgatatcctttgcttgaattagcgaatatgaaatggttaagtcaagccatccaagcaagaaactgaaatagtcaatttgatacgcttaaatgaagatgattaataaaacaggtttgagtctttctatataatagattgttagaatgtgttgttgcgcctcttttgtttagtactttagtagcttcaactaataccgtgtcataactcataattatgcatatgtaagatcttttgtcttttatcatctcgtcgatataagataataagagcgattaaatcaaccctatataataataacaatataagttttctatttcgtttcgtttaatgaaaatatgaataaaattgggataagtttgtatcgcctttttttctttttcacaataagtttgtatcccctaatttaatcatttaaatcatattatctacggctgctatcatgtttacaaatgttctttgtattaataaatagagatgttgttgatacgtaaatttcagcttcagatttttaataaaattatacattccttaataaaaatgtgtgaaagcatgaggaaccacacaactcccaaaccacacgacattatcgtcatttacttgggctcatacgaagcgttacagtattagtaaacgccataatttaggaaattttcagtatagttatacaaatctatactataacttttggtactgcgctttagccaatgtcattaattcagttacgtaacagactccaacgccaaaacattagtataaacaatattaagaacgtggcattaccaacaatccaacaaagatgttctcacatcgaaaccaattagaaacctaaaagatatagtgaaggttgatctctttctttaacatgccacatttttgcatttcttcctttatttgcgaggttaaaatatgttcatttgttaaagaaatttataaaccaatgtaaaccatccatttaaattctcattcacaaatcaatcgttctaatcgaaggatgccaagaaaaaaagcattgttgtcttgttgattgggctaaacattaagacaaaaacagtggcatcaccaagtttttttttgacatatcgatgtttcataatgggctaaatatataacccatttgcccattagtttttttttttttgacgggcaagttgcccattagctaaaaaggctccacaaaacataaaatttggacaattagaaaacctttacctaaactacaaaacaatcctaaattcaaccaaaaagaaaagacccttttttggtataaacggatacaaaacataaatggaaaaatctttattataaagatccaaatacgtggcacgttatattaggtcacaagaactattttgccgacctcaaaaacgatcacaagaataagtttctttcatcgagaaacacaacatatacacaaaaaaactatagcttataaatttattaatattttaataaaatctctgccgtcttcttctttctcataagccacatttcttctctctttctctcctacacaacacagctttttaaacccaacagagcaaaaaagcaaaagattcaacaaaaatctcctcaaattctattc

SEQ ID NO: 457 - DNA, 3000 bp, Arabidopsis thaliana
ttgtgacaaaaaaaaaaaaaataaaaaaaaaataaaaaaaaaaaaaaaaataagcataggatataacatcaataaaggggcagaaatcaaaagacaacaatttttttttttttaaagagtcaaaaaaccagtacacataattggacatttatgacaaaattgttttgggacatttataactactaatagtttttgctaaggtattcgtattatgaggttaaactaaaataaagatgatgttactgattttttttttttaattaatcctaactttgattttaagataagttaaaaaatatgctatatatccgaatatgagaaaaatccaagagaataattagtttactatgctgctggcaatttttttttagtttactatgttgctagtgcttgctaccacacttgtacgtgttcaaggcgtcgtggatatattatacaccatgaaatctaaggttaggtgttttttgctaaatcgttacgtcattgtttcttaaaaataagaattaaaggttaagttacgtctgtttattttgtgtgtgtttgtttataatttgtttatataaaagaaattggaaagataaatgagcaaggtgatttcgatcattagtttcagtccatgtctttgtctctatggtcggccatcggccttagaggcgtgaaagtcttaaacaataatagaacttcattcggaaaaaagaaaaaataacccttaatatttaaatgtaatttagatcatacagtataaataacttcttataccaaactaaaatgaagatggtagctgattaacgaatttacatgcggaagacttaaataatcgatagattagtttatgaaaagacttgcataatcgatagattagtttatgaaaagacttacataatcgatagattagtttatgaaaagacttgcataattggtagatgcaaagttataagaaaactgataaatctgaaacgaggcttgagttcatcaaaatttcctgtgacagcgattattttaatgttactaagacgattgggttgttgggattgttgtagataaaccaggcaataacataatctaccaataacaatgtattgtatttccttttagttgagaaattaaatatttgaccacattatctgaattttcttgtcgtcttaataactaattatcattattcatttttggcaggatctttttttctttgttaaagggtctacttttttttttgataaagcagtcttttatttttaaaacatgcatcacaaaatttaccttcatgaatcaattccctgtgagacaatgatatgatttaaagtttacatgtaaaatattctataccgtggaaaaacactcatttcattgttatataacgaaaaatatgaattatatggacgcaaaataactatttactagatatatcgatgttatagaaataatattatattaaaaaaaacgatatatacggtttagtgttagtgtaagtttatatttttggcacttgttgaaaacgttatgataacttgtttattatcaacctaacatgttttatacggctataccgcataaagtgtagaattaattttacctctttatatgacacaataatatttaacatgtaacaagagcaaggggttacttgtcaaatacgcctatgcactaaacaatgataaattggtcattctcctaatttaaaaagtcactttatcattcttctctaataccaaacctttctatataatcactcttaaaccggccgataacttgttttccaaataatctaaaacttatactaaccaaatttaactaaaatagtaataatttcttacaaatatcaaatcaaaaaatttcaaatccctgacttgtcaaatcaaccatgtttcggactgagaccaaagtctctgcaattcaatgacacatgtatattatatagtattgtttcattaatcacacatgtattttgaccgttaacatgccttgttctttacgtatgttgcactgcaacaacgctttgtcgttaatttacctaacttagtaaaaacaaaatacatgtcttagattatcagttattcaaacttgtcgttatgtaattgttattgaagtaaacagaaactctggtgcgatgcaggacgttactcaaactgagtcacttcgatcggatgtcttaattcaagcaggacaatctagctttgctactgaaatttgatgacacgatgatatatatctatttccaaccgatgaagcacactggagatccgtttggatttttattgtttttacttttttacactatcgtaatcattctttacatatttcctttttattttctccttagaagagaaattatttgtatacaaaacttagaaggctaaataagcatatttattcagtataatcactgtaaccacaccttattcaataaaattcttattttgaatctgtctatttatgtatatgatattgctatagtgatgacagatgagtaaacattaaacatacacgcaacatagctatcttgaaaactgtttgatgatttgagacaaagagaccaaaacaaatggaaccttcttcacatatctatcacacgtcctcatacaccacccatattctgccatgtgttctcactccatcaatattaattatttttagggttaatagagatggtttagtctcatgctttttgtttattactttttttctttggtcagagctttttgtttgttagtaaggactttaaagatagagagtaaaaattactcttttgttttgtcaacataataagcagtttttttctacttcattttgtctccgtatttcatcaagaaaagacacgtatttagatagatgatggaagggcggtaccaaatctccttgacttgactttgcatgtaccatatatatatttgtatatacataaatcataattcatgaagaaaccaaattttctctgtaatcaagttctcaaagcttattagcttctctctctagttctctcacatataacatttgaaaaag

SEQ ID NO: 458 - DNA, 3000 bp, Arabidopsis thaliana
aactttatcattttggtctcccggtagtccggtactgtttttcgttatattgatagtttcaaaatcttacaaagctttttagagccttttcctcgaaaagcaactatgttttgagttttgactttagctttaatttatactcttaaataaataaaacagtgaaaaagtaggtttgttatcctcaatctcgcgtgtaaattagaatatggtggcagtaaattaaagccatttttaactactgaaataatatgttcaattagttggcttaatagaagaaaacatgaaaacatgtgcatttataaattagtacagttctataaaatacttaatatatgtttcaaatatagtactataagtaggtatctatggtcaatgtaaagttaatatgtgacccggatgatgagtaaatagaaggtatgggcgatgtatacccaaggacgtggtgtattatgtactacagtttcaaccgattttgtttttcatgaagtttttaactagtcgttgaaaatcataatttatatccattatgatatagtattaatgtgcagacattatttttaattcattttagaagctcaatgcacgtcggaagaaaaaaattattttagaagctcaatgcacacagccacgacgtgcttcgcaaatcgcaacattcctcatgtttattgtacacgtttagatttatcaaaaatatgaagtagtaaatactattttcacagaactggtaaatatagatatagctaacgttgtcaggtaattgagattttatgtagcaaaatgtatttcttaatagttgttaatgttatctccacaaaattagaaacacgttacttttaattactgtgaattttccaattattaatattaaaaaaaatagttttacagtttggagtatttgtttgataaaaataaaaagtttggtaaaagattatatatagtcgtttttgtttttgtgttaatgcttcgataaatactacctttaaaatcctaataacccgcgtgttatgtaaagtaaaaaaaacgagattactgatgcaattaaaaggtttattgggtaatgtgtcagcgaaagatcatcgtattactgtagactagagtgtaagtcgaaaatgtgctagtaattattcatttctgcgaatcaatttttttttcttccatttctgcgaatcattcttatttctcaagttggtttaaatttaaagaggaagttcactaattacgtaaaactctactatgagagttaatacgagcctatgaccatcaaaagtcaaattaatgaagagtaaatctaattggtcggtaaattgagagtcttcaggattcagttacagttgtctataaataatttctatagagttatttgattttgaggtttgctccagtaatttacgattttgctagtgggcattcaataaaagagacatgtgtattaaactaagtaataaataatcatgctccatattaccccataagttatggactttgaggggtcgacaattcaatggatgtattcacgaaaatggaggtgacaataaattagggctgcgtggtgtaagttgctaaaatttggaaatcgatgaatttcttatacttgtatcagaataattatttttatacagtatattagtatatggactctcatgtgctggttacaaagatcttgtcgatgcagtttcgtggttaaagatgatagtcaatgcaacattcaagagcaaagtaaaaattagaaagtgataaatatatcaggcacccaaaaatttaaatttaaatatttcttgtgttatatttagtttagatcttcacgccaagaaaaagcaaacacttatctgtatattgataaatcggaagagaatatttcgggcagacgcagcataaatgggttcagcattattcagaaaatcatttctcttaaataaaagaacttctaaaaaagcacatttttctattataaggtatttatctgataaaataaaaaaccacaagaaaaatcgaaataatagccttattttctctcctttaaattttgtcttctttcggtgccacctcctttatttctctcacacatcctgcattaataatcagcaccacacggttttgaatgtcaaaacttacatatatattcatacagtacatgaactcatgcttatcgtatacctatatgaatcttttgtcaaaactccgcatatatattcgctgtaaaatacgtgtgtaagtgattaaaactcgatggttcaaaaaaataactaaaacatatttattcatcagaattttctcacacaaacttaagattgatgatagatatcaacaagtacatgagttgaagcctgttataagttattatgaatccgattattattattgtgtgtttatatttttgcctttcacttgtgtaaaaaaactaatacttactacagtataatctaataatgtactgatatccattgatgtgtcattatttagattcaaatttggaattttgagtgtgtgaattgatagtataataaagacaaaaacgtaaagtacttgcgtttatgtttgttacttttaaataaaagacaacaaaatatcattgatatttgtttaattactaaacgtaaacgtccaaaaaaatatttgtgtttgaaaccgtgtagagtaatccaaagaaggagagagagatagaagaagaaggctgactttggagagaaagagagtaaatgcattttgctgtccatgttgactctttgaaagctagcctcttcattattgttgcttctcattccattattttattaattacttactaattaactcttcttgtttctctctcacacatcaatcttacttacttctttctataaatataaccaacatctctcctccacttcttcagacaaaaccaaacccatttggactttctttgtcttaaccctaagatttccaaaggttttccaacaaacccgcaacgattagcttttgttctaatatctcatcaaaaccctttcaaaaggtgaaaacaga

SEQ ID NO: 459 - DNA, 3000 bp, Arabidopsis thaliana
atgaaatagtacttggtaggtacaaaaattaaacgttttgattccacacatacaaaaagaagaagaaaagagtaactttttatttgtcgtccaacaaagaatcgcttttcaatcaagctttagtgaaggtgttaggtgtgtgtggcttaagcatatacatcagaagaccaacaaaatttatcttaagcacgaaggtcaccgaacgtagtcgtttcaacgatgaccgtaccattaatgcagatttgtagtgcgtgtggatatatacatgcacacgtgtggaaggtgaaggtacaaaatgtgcatacggcttaaggataagcgagaacacggaaggatattttgtagcagcatctttctattctatgcaactaagtaaacgaaccacatgcacctgttttctttaatttattgcctttgtgattttttttgttgacaccattatgttttttttttgtttgtaaaccatataattaagtagtttccctaaaccgttaacaattaatacattctataatgtcgaataaaaagaaaaggtaatgcaagtggaagaatatctaaacacgttagtagaccaatagcaaaattacagttgctagcttacacgacaggaggaacaagacaagagtagttttgcctttgttaagaataattagcatgacacgtcactcaaacttacacgtggaaggataattcatggacacgtggacatactggaaaacagctgttaaatctttgtccggttatcgtaagtttttgaattttaaaactgtatttagccgaattaggtcatgttccacgtgcctttttttctgcaccactatctcttttccacaagaggggcaatgattttttggtccaaaaatatacagttgtaatcttggacggtgtgtcttaaataaaataatatatggacggtgttttctttaatgttttctatgttcatatgaacttctcggtggtcgtttcaatcacaaaatttatcataccagaaaacaaaatattttcaataattgaggctgtacgttgtgtattttaggttttttctttagattgttgcatgttatattttcagtttactatatgttgtgatgattattcgttacaaatgttttcaaaatgtcatactatagtagtcatttataatagatatgaaaaatgatcacagttgatttgtttttttggtggactacgaataaaatcgttttggtaattgtctaatcttcgagtgagtaagacaccgtcaatcaaccatcaatatcatcaatcaaaaccattattgatctattttttggtttaaggaaaagttggtaattgtaaaacgacttcaataaaatatttaaaacaaggagaccaaaaccgacactcggaccattgataatagaaacaacgagcaaggttatagtagtatagttgagtctcacaaacgaacacgtaaacccaatataataactacgcaaggttacatctagagcttattgttcccatcacaataacctcttggcattattaattatcaaattcactcaaagtattaaactcctgatgtctaatagattatcaacaaatcgacaaaaatgtagatatataactcaaaaggtataaattcaaatgtttggtggggttacgtaaaaacttgaattattaagaactaacaatactatagtttaattaaaaggagaattatgaaccgttagagggaaggttagggagcgtgcatgaacattacctgacgtttaccgacctgattcgtaccgtacataccagaacaaagagcttttaaaaacccgcgttttacgaccgacacgtggcagttcttaaatggatgacagttagtgttttattaattgtttttgtttgattaacaagttttatacagcctggctgtttctattcgtattttcgatataataattaaatatatttcaggaaacaaaggcagtgatgattttgcgttccaattcggcaacctatgttgtcgttttctgccacgtcaaaacctcctatcttttgttaaccgcacattttacatcacgtttcctaaaccgaacattaatatctaaccatttttatacattcacttaatatcgctcacacggttctttgtcaatcccattttaatccagcttcgtttcaaattattgaggtttagatctttttatgatcatagagcaactatatatagatttagtattgtcaatttgtcatgcactgttatatgcatgaattaggtgtttgtgtgttgtttagtaattaattataccttcttagtgacaatttgttttctttattagtaatgaaatttgtggtcaataattttgattagttttcaacccggaaaatcggttatatgtaaagtagatattatcataaagtttttatgtgaagtgctatacagcctggcttcgctattctaaagtcaagactaaacataaaaataaataaaaactgtccttacccaaacctaaccgttatcatctttttatttttttcttcagatatttctttttcatttttatttcccctataaaaaaatttaaattcacctcaaattgtgcgaatattatcatggctttgctagttgggtttcgtgattttgtctctttaacttcttactttcgccacgcgcttaaatggcgcgtgtactcacaaactcatactttgagactcgactgatctccacgctcaactatacgaaattgctgatcttgaacaaaattattacgaaaacgacaaaaaagacacatcgacgtagtcaggcttcgacgcgtgtccacttacagctgtaccgcaaactttgaaaaaccgcttgcgtggaagaagcgttgcccatgacttctccaccgtcttaaccggtttccggttatcctcctctcttaaatctctgtataaataattttgtcctctctttagtttctcgaacttgtttttggttcatctctcaaaaccaaaatcactaaagaggagaagattgctaaagtttgataaaacattccaaaatca

SEQ ID NO: 460 - DNA, 3000 bp, Arabidopsis thaliana
atctgaaactgtgtgttttttggcagacacagatcaagaaccttaatcctctatggtatccgttggagagccagagcgtcgagtatttcaggttgggagatttttgggattgtttcgacgagtggagtgcttacggtgcaggtgtccccattgtatcggaaacgggcgaaacattggtccaatactatgttccttacctctctgcaatccagattttcacctctcattctgttatcaatactcttaggtaatgatcattatgctgccattttcataaacacaagcatatattcaacaatctaacatgtcgctgcgatgaatgatgatttagggaggagacagaatcaggggattcagggagcgagtcgtgtagcgaggagtggagatgggaaggatgttcttcgtctgaagaagggtttgatcatcaagaacctctcgatcgcctcggttactcttacttgcagtatttcgagagatgtacaccttactctagagtccctctcatggataaggtttgttccccattcttggagtttgattccagaagcactttctttcattgttttatgattccataagtctctgtctactttcagatcaaagagttgggagaaagatacgtagggttgaggtcattgaggagtgttgatctgtctcctgcgagttggatggctgttgcttggtctgccttttcttctttttcttgtttcagaaaacaaagttaaggttaatgtagtaaaatggtgacgatgtttgattgtatgtgtaggtatccaatctatcacattcccatgaatagaagcataaaagacttgtctacttgcttcctcacttaccacacgctttcttcatctttccaaggtgcattttcactttcctcttggaagtgtgtattaatgtattagtacattcattccccatttctaaagtcccttggcattggaacagatgtaaaaagggaagaggagaaggagaggataagtgtgagtgcatttgggatggccacttacaagatgcaagggaggctatgggataatgatagattgctttgctttttgagcgtagcagattcttggctaaagcagctaagggtccaccaccatgacttcacctacttcaccactactactcattatctttgatatatgtagtgttttagatcattacttggttaacagtctatttagctttgttgtttaagagtagcacatatcaataatgttggattgttgttacttgggactctttgggaaggataggtactgactttttcttcacaagacttttatatcataaatttagtttggggtcagattgatgatgatgggctcaatacatttattcttttctaatgttttgtggctttctgtttgtacaaacgcacgttctcttgattttggtatccttctctttttaacaattttctaaatttcataacaaaaaagaagaagatatatacagagatatatattgatttacataaaagattatcacaaaaatctctagaactttctacatgatatttagatatatttatgttacaattatctcaaatttagtttcttagcctctaatataatattctgatattatgtacttactaggaattatttatggtgttttagattgtttctgaagatacctcttaaaattggatcatgttttaggcttctttcgacttttgtccaaatttgataaattggatcattggcccaaaataaagttggttcgtcttttttatgctcacccctaactaaaattacaccaaaaaaactatactgtttctaaacattatcacattatagtattatacacaacaatattaactcataaaataaaaagaataaatgtgtgccttaatattcacgaattttcttaagaataatactcttatagagattttagtagattttcttctgcacccatcttcttttttgccactagaaaaagttacataaaaactgtaagttgataaataaataaaactgtaaattccaacaattagtttggattttccacctgaaatctttatagactatgtttattcctcacaataaatagaagatatgaagaataacatcacgcatagtcgatatgcacgtgagataatatgttgagatttagttaccaaaaaagaatgattttgtctgagaaatgaaattcctctagttgtgaatttttcaaacttggtcggtcttgtgagttgagtatctttttgaggggaggtgggaataataataagcaaaaatatcttaaaaaaaagcgaaagctgagtttgaccaatcaccgacccggaagattgaaactataattagtactacgtttggttgtcatcaaaatggtcattcttatggttatgggatattatcctttgccgcggctagccgaccattacaccaacatcatttttttttgtctccattcaatttgcataaacctcttaaattatagatgttttttacagtctaatcttatcttttaactttgtaagtggtgtcgccttacgaaaattaaagcttggaaaataactaaataaagttgaaggatatgaactaatgaatgccttcaccgtccaaaaaaacagagaatgccacgtattcgtacggacgttaatgttttcatctctgcgcgttgtgtttttatgtgtcaatatctctctatttttcaaatgctcattttcttaactttcttattggccaatgaattggagtaaaagcaaaggaataaccccaaaaagatagttttgaatagtcgtcaatagatagatgggacatacaaattacaaaagcggttagcaaaatctttcgttgaaaaaaataaatatctaattcttgccctcatatataaacccatgtagagtcgtctctctcttaccaaataagaacaaaacaagacataattttctctgttttcctagctctctcctctcaaattcttccattgctctctgttttggcaaatcgtgaactgccacgtctttaaggcatcagtgaagcaaag

SEQ ID NO: 461 - DNA, 3000 bp, Arabidopsis thaliana
gatgaagtaaacatgaggacaatttaacgaaagttaagtcacctaacgctttgaaatccaacctaccagcctgaatttatatttacaccactttgaataactcatttctgattagagttttttttgtttgtttgttggaaagctgactagttgaaacgttagactctaaatagcttgttaatcaaactggtttcaactatcttctttaaaccactttgattttatagctactaaatttatttacggattatctttaattactttcctcatataattagtttcttaagccaactataaaagaatcaaaaattagaagactaaaaaaaaaaaaattagagtaattaacaacgtgggttattgttaccaaaattaagaaaaatacaagaagtagaaacaaacattaaaatggtccaaaatctgtttaagtagagataatggtgtagaccttaaccagctcaatcccattgttgttatctctttaattactacaatacattttggatagtaatatttcgttatgctaattgcttgtattcgatcgacacctattattacccgatctttatctgaaatggacggttatagactaaaagttgttgagatatttttaattaaaaaaaaaaagttacgttgcagaattatttcataaacaatgaaatacagacattaaaaaagaaaaacgattagagttggtgatcgttattaattaaatatcttgattaatcagtgattagtaccaatccatagaatcttactggttaatagaaagtggaaaaccagttggagaaaagataaagtgaaaaaagtaatgacgcggcgagataatgaagaaaaacgtttgtggtcagcacaaaaaacgtgttcttatcatttcgacacgtgcgtctctctctctgcctttttagtggcttaataagtactacttttcttctggataaaggtattattaggtttataaagctttaacgtcttgtttcattttttgtttttaacttgtataggagcctgccgcccttaatcacatagtcgcatgcattaatacttactacatagtttaataactatttctaagtcaaaatttattctttgaaaaaaacatttaaaaaagaattataaactctttcccaaattttggataatttgttgactttttttgttgttaaaataaattgttgactttattgtcaatgattattgtcaatgtgaccatactcttcttttcttggtggattgaccataatctttttttgataagagtaccaaaattagtaaaaagtttacagaaattataattccgaattgttgagatatatctacgtttttgaatgttgtaatataattagtcataaaactttttactatgattctctttaaattcagttctttttaagtttaatgacaaaatgtgagattttttttgttttcattttcgatgaaccccatatgttttaaaatgaaaaactgctatcctagtaaaagacacgattgtattaaacgttttgaagtaaattttcatacataatccaataacaacagaaattcttcgtctatggatttttgaaagtagatttatagatgatatgttttcttcaaaatcctatataaaaataatcgaagtactacaggatagattagtttgttttgtatgattaaccggtagagttaaatatgtgttttaattggttatgggacaaagtcagaagactaatatggcacgtgacgtgaatagagtctttggaagcgagaatacgtggtgggtcagcgtagagaagggtcaacacagatttatacttttttttgttgtgaattaatccagaagccagctcatcaacatcaacgcttcaacttcaacttctacatccttgaaatatctgagtcctatatcattgagaaacagtcaaaccttctctttcactatgtacctttgacaagttaagctcattttctccttccaccatttatatcccaagaaagatcattttgtctcatattaggtgaattgctcatattgtcttttcttttttaacttggatttaacgggtttataacaaattaataatgatttttttatataggaaaaaaacgttgttgtattatttatttctcttaaaagggactattacattttagcaagatcgaatttccaaggttttaaacttcaaaatgaaaaatattaagcaaagaattagaaacaaaaatcgattcaacgttatgtggaaccataatgcaagattttggtaaaccgtggaatgtctcaccatgtgtacttttttgaaaaaatcccaaaatcaacaattgtgaagagatcttcatgagcttgattcgacgtactagagtatataaaaaggcaaaagataaatttgagacgatggatctagtcatcaagtagaaagacaaattgatctctctattcatgactgtgaaggccattgatgatcaaatagcatgtgaaatcataattttgcacgtgatttatcctaagccaatcagtaagttacctagctacttattccattaaacgtgtttaaatttatatgtaaactgtgttaaaaaggaacaattgataagcgcaatcataataatactaattaaattaacaaaacagtaaaaagaagttcttgaaaatcgtcatgtatgatgaaatgattaatactaaataatgtttaaagaaatgtcatgtcatttaaaccccccaaaaaaaaaacaaagacgtcacattcaaatgtcaaaaaatattcgaggaaataacgcacgtgtttccaaaaacacagatcagaatacgtcccgtgtgaaaagagtgtgtgccagttaggcacgccacgtagatacttgacaaaaacacggagccatataaatagagcttctttctcactttcagtttcccaaacacaaacaaaactcatattttcaatctccaggtgctttacaccaacagagtcgcaagaaaacaaaaaccaaactcggatttagtttgacagaagaaggaatcgagagtcgggt

SEQ ID NO: 462 - DNA, 3000 bp, Arabidopsis thaliana
ttgttcccatccctcgttgtagagatctagtctttttccaatgtcttcttgaatcctcttaacagttgggtttttagacactacaacccatattgcaatgtcaaaatcgttgcttactgtgcggaacttgttgttgatttgagagaggagggtggtcttgcctactccccccataccatatatacccaaaagcccaactcccacttccatcatactattccatgttgattcaacaattgcctcttgaccaactatctcctggtggaaaagcctttcctccacctttggtataggacctttttgagcaacttcatcaaaaacgcctttagatagaagattctcaacatcttgcaacttgttgattacacttttactatagtcgtagctatatttacatctcttagaacaatattggccacaacataaattatctatttcttcatcgctttgcgagaggatatcatgggcttcacataccctactttcgacctcagaaagccattgttggacttcatccaataggtttagacctctatcttcttgtaccttaatccttttcaacaaatcatctcgtcttgcctccaactgtcgtacagttttctttagagccgctacatgatctacgaggttgcggaagcgattttggttcctgctaaggcagcttgtaaggttattaacagcctggtcacaggatattgccacagagaagcaggctcccatctctcatagattctcaaattcctaccagagagattaatatacaaattcctttcctaatgttttagtttattaactgaggtgtgtgcacgatcattcgggttgaccaccaatcttggcatccagtcatctacgactcgatcaaatatttatgttattttaaaaatgaactgtaaccaagataacatttttttcataaggtcaacgacccttgggatgttaacagagccaagtttagtgagcactatgtgctcgttttttcttaacacaattctaacgtggtttggccaagccaagtcaacattttacttacatctcgttttccaataatggttttgtaatcgataacctaaatcattgtaatgaatgcgttcctccctatcgatcctaggccttagacaatgctgaatgattcatagccacgcgaataacctattcatactaatatggaaagaaagaagccaaacttacagagctcttctcacggtcgtcgaagaaaagagagtctacagtcagcaacaaaattagtgttgccatcatggcatcatcttgcagctttttccgcacaaataatttatcatccaaatgttgttcactaaaccaaaaacaaacaagcattacagcgaagaaaccaactcgtagatacagatttccaaattcatgccttatttagaccaataaaaactgaaatttctcttcagcgaaaaaaaaaacaaacaaactgaaatttcatatagatccagaagatagaaacttgtaggctcaatcgactagactagaagatgctcacccgatcgtgcttgagatagcgagatagtagcaacaccgacggtagaaataaaatggacgacacccatccaatgggctaatttagattaacgggctttaagggtttgataatggatgttaattaactgaggcacatgggattgtatcacgtaggcaatgggtttgataatggatgttaagtaactaaggcccatgaggttgaagtacgtaggcaattgcgtgagcttacgttagcgatgccgttagagacacgtagtggatgaagtggctttggttagcaaaggacacatgaggcacatgcaaaggctataaatgactgctgctttgctacaacttgcgattcccaaattttataaggtaatggaccctatcacctctgctcgaagctaagccacccaagtttgagcttcaccatttgacacgtctctagctaatacttaatgcttaaactttaaactaatacttcatgtttaagacatttctggctgacacatttatgaattcgctctatgtcgtacgtacaccggaaacctttaattttacaatattaaccgtgatctttttaaaaatatctatataaacgataagtatctcatcaaaacaaaattgaataatgtgcacgtttgtaaaaactagaaaaacaggcaataaacatcatcatccaattacacatctagtaagtgtgatgcagtggcaaactggcaataaaccaagaaaaatcgagaaagagcagatgagacagtgttgtgttgtcagggttaataaaaaaaaaatgaagatattttaaaatttcataatatttaaataatgaagtagttttatgatcttatccataaatcaattttaaaaaggtttaaactttacttttccgtatcaacagcgtgtttcgagaagattcgggaggacactcgtcgaacggaaaagtcgtctaagcctttatgttcgaatcaaaaactgacacgtaaccttgctctcaaacagaaaaataaaataatgttagaaaaatctagagaaggctataaatactccgtagatactttgtcttccttagatattttgatttctgctaaagctgtctgataaaaagaagaggaaaactcgaaaaagctacacacaagaagaagaagaaaagatacgagcaagaagactaaacacgaaagcgatttatcaactcgaaggaagagactttgattttcaaatttcgtcccctataggtacgttgatttctgatttcttacaaattttcaattaatttctctgattaggtctcgtcaattggtgattctagggtttatcttcgtctttaggttttcgattatttccttttaggtatagctgtgaaattgggaaattttaggtgttcctaatttgataacaaataagtaaatcgatctgattttgaaccaagtttaagttctcttgccttatgtttcagcttgtgttctgatattgaagtgttgttgtattgtagattgtgttgtttctgggaaggag

SEQ ID NO: 463 - DNA, 3000 bp, Arabidopsis thaliana
gcgtctcgttcagttgcttaaaaatcaagttttccccaagcttcaagttagttgatattttatgatgatgatcagtgtaacctttgattacgatatattcagtgatctttgtttttatagtatgaggtagcttgggctctaacaaacattgctgttgacaatccgggcgtggtagttaataacaacgctgttccagtattaattcagcttattgcttctcctaaagattatgttcgtgagcaggtaagtattttactacgtgtagatatgagaatacttgtcacagactcacagatatgagttttgacattattcttgcaggctatatggacactgagtaatgttgctggtcattcgatacattaccgtgactttgttcttaactctggggtattgatgccactgttgcgtcttctgtataaggatactacactcagaattgctacttgggctttgcgtaacttgtgtcgtggcaagcctcacccggctttcgatcaggtcttcttacttctctctctgtctctgtttcctctgttttgtatactttttaacatatgaagcatgattcaacaggtgaaacctgctcttcctgcgcttgaaatacttcttcattcacatgatgaagatgtcttgaaaaatgcttgcatggcactatgtcatctgtctgagggttcagaagatggaatccaaagtgtgattgaggctggttttgtcccaaaactagttcaaattctccagttagtacttctcagaatatgtatttaacccttttgtgacatgtttggataaggaaaggctgacagttttttttcttttgcagactcccttctccagtggtgcttgttcctgcacttcttaccattggggctatgactgctggaaatcatcagcagacacaggtatgtatttcatattcaacttacgttgtccaccttttggattttgtaaccaaacaacaaaatgctttgttatacacctctttgaacttattcttcagtgtgtgatcaatagtggtgctttacccattatttccaacatgcttactcgaaaccacgagaacaaaataaagaagtgtgcttgctgggtgatttcaaacatcactgcagggactaaagaacaaattcaggtgagaaacttttgttgctattatccccaatgaaaatttaccatttttgtcttttgctatcactaatttgtttttctttttcccctggtgattacagtcagttattgatgcaaatttgattccaatcttggtcaatcttgctcaagatactgacttctacatgaagaaagaagctgtatgggcaatttcaaatatggccttaaatggttctcatgatcaaatcaagtaacgtccctgtcttgtttcttttttcaactttaatgtacttattatagatcatcaagtctcacaattctccattggtgtgattcagatacatggcggagcagagttgcataaaacaattatgtgatatcctagtatattcagatgaaagaaccaccatcttaaagtgtctggatggattggaaaacatgttgaaggccggagaggctgaaaagaacagtgaagacgtgaacccttattgtctactgattgaagatgcggaagggctagaaaagatttcgaagctgcaaatgaacaaaaacgatgatatctacgagaaggcttataagattctggtgacgaattggtttgaagaggatgatgagaacaacaacaacaacgtccgatgtgatgatgtggactttcaggtgtgagagaaccaaagttccagttccttatatggaagatcccaacacaattatttgttatagtgaaaaaaaaacatcttacatgggaccaaaggctttgcacctttgttgtctcagggctttacttggtctttaattgaatgtacaaagttgatgtaaaagctttggctccatcgttcatggagtctagtacattgttttgggttttaaaagttttctgtgttaaagctcgtcgtctaattgatgttgtgtttggttttagttgaaaggtttagacgtttagtaaaaaagttactcaaattcttgaaatctccttggccttgctgattataaaatcaaatattcatttataaaattatgcgaaagggtctaattatttttgaaaccgaatcgaatgaagacaactccattttgattgattttttttttgttgtattaaagaataaaaaactcgactggttcaacaagactggattgtctttaaactactggttcaatgtattttgggtacataatgaaaaaaatacacaatccgccttggccacgtatccatctttggcttagttgatgatgataatacttttgttttttggtaaggctgatgatgataatagttagaagaagttcatagaataatccaatggatttccaataataaaacacagaaataaatataatccaaacaattgccaaaaataatgaataagaaaagggacccacaccaaaagctaaaagcgcgtgggtcagattacaaaaagcgaaaccccaaaccgtggctagacagcggacgaacccgtcccttcaaacgtggctcacctttcgaaccacagagagcagtttacactccaactgtcaaaaacgtgttcccatgacgtcatcctcaacgtatctttatcactttttaaaactaaagactgttttgtctttttctaaatcgtcccctttctccgaacaccatacttaaattcaataaaataataaatatcaaaactgaaccatcgaatcggaaccagccacagtacacaatacacttagacgaagtaaagtgattcagaaggacacgtgtaagtcacataccgtgggacacttgtcgttaccagatcctccgtgtttctcacttttcttataaaataaaaacacaacacttcttcactttctgtaataaaaatatctccaaaagttccaacacctgaaaacataaaaagatagaaagagaaataaaacatcttatccaaagaaaaa

SEQ ID NO: 464 - DNA, 3000 bp, Arabidopsis thaliana
tggaccacttcaatcgcagcccaaaaattcttcttgggtctaccggcagctcctgaagctgccggaagtggctatatcccaccagatgtactgacttcacagattcttccgactttaaagaagtctaggaagtatggaggtgtaatgctttggtctaaattctgggatgataaaaatggatacagttcatctatattggctagtgtgtgaaaagaatcgttatggccattgtatgtgtatcaattctctcgtatgtgtatcaattctctcgtctttggtttctgaagaattgttgtgtgtgtgtggtgttagtagtctaatttaaattgtttgtatcaatatacttaatcaactttgctttttcaatatttttttttaataaattatggattcgcttttagtatgaactgatatagatgtagctagctgcatgcaagatttgtttttttttttacatgaaaggtttttttagagatacgatatctactttggaactatatttgaaattgaaaattatcggaagcgcaaagaaacgagatgaatcatgattcagaagaaaaataaacatattgtaagcacatagaagacttctgtccacatcagaaggatgaaaaaagatttttgactaatactccttctgtatattatatttgatgttttaagttttggcaaaccgatattatttattaactatttaaaacataagatttaactaattgtaaaattaatatgcagaatataaactgtcaaaaccaataaaaaaaaatctattttaaaataactttttgtaataaaagatcaagtaataaacagagagaatatatactatatatatatatatatatcgtgttcaaaaaaaaaaaatcattatatatatttagacaaaggattagtctaaaatatctaatctaattgagctatgaacggtttaacatgcatgcactagttcatttatttgttatttgcttcataaacaaggattgatccaaataatcccttcaaaatgagtatagtcgtcaaataactcattcaatcgatttttctaatggatctaaaatgatgtaccattttggctagccaaataaaaatagtttgatgatttcatttaatttgttgccatcatttaaacttttgaatatgaaaagagtatgtagagtaatagtaatggggaacgcataaacattagttgatttgtgctgatttatgttgatttatgcgacactatattatcttacgtaccatgaacacacatttcacaaattatagatcatatattggtgtgaaaaataaagttaattgttacatcttcgactatagctggagttttcatcctattaaatattaataaaaaaatacaaaaaggcacaaaacaggtgccgccatatccaatatatccaacatcgtcaattattcagagccgaccatttacaaaaacgaagaccttttgtgaaaatctagttcaaccataaaaacacgtgccacaatctcattcttcagagttctcccaccgaaccatctctctaaatgcgttcaaattatataagtgagtgatatataaagattactaaaccacatggtataccgattttttagcctcattctcttttgttacaagattctactatgtcttcatttcatttttattttccttctgttggtctcttctcattcttttgcttcttcttagttagcttggccactgaaccgcacatcggtttgggttcaaagctaaaagctagtgaaccgaaccgggcatgggtttctgctaacggtacttttgcaatcgggtttactcggtttaagccaaccgaccgattcttactgagcatttggttcgcacaacttcctggtgatccaaccatcgtctggtctcccaacaggtacacataatcctttgatatttagttattgaagcaatctatattagtagtaaatatatacaaattttatgttaagctcaaataatttctttagtaccaacgtttgatttccctatgatcagaaattttccacattatttttactcaaaaatataaatatctaaaatatagaaactccccagtcacaaaagaagccgtgttggagctagaagccacgggaaacctcgtactctccgaccaaaacactgtcgtctggacctcaaacacgtcaaaccatggtgttgaatcagcggttatgtccgaatctggaaacttcctcctccttggaacagaagttactgctggtccaaccatttggcaaagcttttcgcaaccttccgacactctcctcccaaaccaacccttaaccgtttccttagaactaacctctaacccttcaccgtcgcgccatggccattactccctgaaaatgctgcagcaacacacttcacttagcctcggcctaacctacaacatcaatcttgaccctcacgcaaactactcgtactggtccggaccagatatatctaatgttacaggagatgttaccgcagttcttgacgataccggaagcttcaagatcgtttatggagaatcctcaataggagcagtgtacgtctacaagaacccggtagatgataaccggaattacaacaacagtagtaatttagggttaacaaaaaatccggttctgcggagattggtattagagaacaacggtaatctccggttataccgatgggacaacgacatgaacggttcaagccaatgggtccctgaatgggcagctgtatcaaacccgtgtgacatagctgggatttgcggtaacggagtttgcaatttggaccgaaccaagaaaaacgctgactgtttatgtttgcccggttcggtcaaacttcctgatcaagaaaacgctaaactctgttcagacaactcatctttggtccaagaatgtgaaagcaacattaatcgtaacggtagcttcaagatctcgacggtccaagagaccaactactatttttcagaacgttctgtcatcgaaaatatcagcgatatcagcaacgtgaggaaatgcggtgag

SEQ ID NO: 465 - DNA, 3000 bp, Arabidopsis thaliana
tctggtgtacgattacatgcccaatggaagtttagacaagtatttgtacaatagtccagaggtaaccctcgattggaaacagaggtttaaagtcattaatggcgtggcctctgccttattttatctccacgaggagtgggaacaagtggtgattcaccgcgacgtcaaagccagcaacgtcttgttagatgcagagctcaatgggagactcggggatttcggtttagctcagttgtgtgatcacgggtctgatcctcaaactacgcgtgtagttggaacttggggatacctagcccccgatcacatcaggacaggacgggccacaaccactactgatgtttttgcatttggggtgctcctactagaagtggcgtgcggcagacgtcctatcgagattaataaccaaagtggtgagagggtcgtgctcgtggattgggtttttagattttggatggaggcaaacattttggatgctaaggatcctaatctagggtctgagtatgaccaaaaagaagtcgaaatggttttgaagctaggtttgttgtgctctcactccgacccactagctagaccaacaatgagacaagtgctacagtatctaaggggagatgcaatgttaccagatctgtcgccgttggacttgcgtgggagtgggatcatgttgggaacccacaacgggtctaatgagtcgggcatgtttaccagtggatcttctgttgcttattctctactctccagtgggaggtgattttcgtataccataacgtttgtagaaagcaattatctgcaaaagatagaggaccatgaactcaaacgtgaaatatttgaaactctaacgtttagttttattgttgctgcattgaaagtgtatggttatcgaagtataattatgtatcacatggcttttcgattaatagtgtttcctaagagcatgtccattgcagagaccttacaagtttcttaagagaatcctaatgaaaagaagcaaaaaaataaattaaaattgtctaattaaccaaggtgcgaaccttaaataaggtatttttgggtgagtaaggttcgctgacgtggcactatatcattggaggaccaataaaacaaaataagtttttttccttttttctttctctcctctctcttggtttcgtatagagtttctgggctttggtttatgttcaaatttgtgtttgatctgttggtttttaagataaaaatgtgacccttttgctgcttattcacttctcattagcattacaacggattggtgacacaaaataattggttctaggtttatgtttatgctcttttgtttgctcatttagttggtgttatcaaataattggttctaggtacgtgctttcatttaagttcatgacagtgtcttgagctggagatagattattctatgttcttcctttggtgacaatttcattaatagacctctcatcttggactttagtttcctcttgtaagccttttgatttgtattctttttctttttttttttgcttttatgtcatcatatatgtttacaatttgtaatattttttaataacttttaagttttatcaaataaattattttaaaaatatttttgctttttaaaaaaattttcataaggactccaccattggataacaaaaaatttagagactcaacaaaaactctaaactttaaaattaccaaaatatattattaaaaaatgttaaggattttttataaggattcaatcaatgggcatgctctaagacttttaaatatttagagatattttttcttggctgatatattgtcctaaaacacataagtcacaaaatgataggttaatttcactatatcatataaatctcatagagtttcactatttcaaactatttttacatattgtgtgtacactttaagaatatgattgctacaaatttggcgttaatattttagattaatggtcgctaacaccaacttgtctcccaaatttagagttgaattcaatggcaataaaatagacataatttaatcacggaaagagatatcaataaactaataagattatatattacattaaaaatatatgtaaatataattagaagcgataaaaattacaaaattatcaagtgattattactttattagtctagtgatagtgagtagtgagtttcttgaaagagtacaaaaacattgacaataatgctttcggattatttttgaaagaaatagtctaaagacggcatctagatcaaatggatatcataaacttttgatccgaatgttgcggttatcaaaaaagaaatgacaatagtataaaatatggtagaagtattgtctatccttatttcttaagcaaaaatgatctctattttatgaacaactagcaataaagaaaatgtggaaaacagatgataagttactctggttcctatattatatgaaacagagtagtgacaccattatttggaattcatggaaattaaaagaaaagactcggtctctttgaattagtcatgactatccttgtgcagatattaaaatgcctgacggtgaacaatttttttcaagttattttatactacgtgtgtggtcaaaatcaaaaccaaaatcactttttgataccacaaagtaatttgaaatatgcttttgctcttttgttataggaaacagagtagtaacaccattacatgcagttaacaaaaatcaaaagaaacacttagtctctttggttttgttatgactatggtttgtttttttgtcagcttcactaaataagacaagagacaatacacgtagtagttgtaccacaacatcattaccaatcaaagcctttctgtctttgtcttcgtgagtctccacaccatgacttctaatttggggtaaactacgacttttcctttgaccaacaaactacgacttttctacactctctttacaccatatattattactcttattttcattacaaactcaataatatctaaaccaaaagccaaaacacacaaaaacagagcc

SEQ ID NO: 466 - DNA, 3000 bp, Arabidopsis thaliana
caatccgttcttttagcacttccttcgtatttgtcatcatccctacaagctctagcaacggaggttttggcttcaccttcacgctatctccaacccctgatcgtaccggagccgaatccgcacagtacttgggacttctcaacaaagcaaacgacgggaattcgacgaatcacgtttttgctgtggaattcgacacagtgcaaggttttaaagacggtgccgatagaacaggcaatcacatcggtctgaatttcaacagtttaacatctgatgtccaagaaccggtcgtgtattacgacaacgaagatcctaaccggaaagaggatttcccactacagagtggcgatccaatccgagcaattttggattacgatgggccaactcaaacgctaaacttaactgtctacccggctaacttgaagtctagacccgtaaggcctttgatctcgcgacctgttccaaagttgtcgcaaatcgtgcaagaagaaatgtatgttggattcacagcagctacagggagagatcagtcgagtgctcactacgtcatgggctggagtttttctagcggcggtgatcttctaactgaagatacgcttgacctcttggaacttcctcgtccgcctccgaacacggcgaagaagagaggttacaattctcaagtactcgctctgatcgtagctctatcgggagtaacagtgatcttgcttgcgttactcttctttttcgtgatgtacaagaaacgattgcaacaaggagaggttcttgaagactgggaaatcaatcatcctcatagacttagatataaagatctctacgctgctacggatggattcaaggagaataggattgtcggaactggaggatttggaaccgttttccgaggaaacttatcgtcaccttcgtctgatcaaatcgccgtgaagaagataactccgaatagtatgcaaggtgttcgagaattcatcgcagagatcgagagtttggggagattaaggcataagaatctggtcaaccttcaaggatggtgcaagcaaaaaaacgatctcttgttaatttatgattatatccctaacggaagcttagactcgctgctctacagtagaccaagacagagcggtgttgttttgtcgtggaacgcacgttttaagattgctaaaggaatcgcgtctggtttgttgtatctccatgaagaatgggaaaaggttgtgattcacagagacataaaacctagcaacgttttgattgaggacgatatgaatcctaggttgggagattttggactcgcgaggctttacgaacgcggatcgcaatcgaacacgaccgtagtcgtgggcacaattgggtacatggcaccagagctagcacgcaacggcaaatcttcgtctgcgtctgatgtttttgcgtttggcgttttgttattagagatagtctccgggagaagaccgactgactcagggacattcttcttggccgattgggttatggaattgcacgcgagaggagagattctccatgcggtggatccgagacttggatttggttacgacggcgttgaggcacggcttgctcttgttgtgggattgctctgttgccatcaaagaccgacgtctcggccgtccatgagaacggtgcttaggtatttgaacggagatgatgatgtacctgaaattgataacgattggggatactcggattcttcaagaagcgatttaggatccaactttgaaggatatgtttcatcggatagggcttcgagctcagtcccatctttctccgttacaagggtttcttctagttctgttatcagtggtagatagtacaaagtcaattacttcgagtttttttctgttgtaacttataagcaataacagtagtacaaattttgtttttcacttcttatggtatttttggtatttagcattcaaacggctagtttaacaaaagcgtatagctaagagcggtaaaataattttaaataacagacggtatgcaacatttacggctacgaactggaatcttattttacatttgtaaattgctaagatgcttggccgattaatcttagaaattgattctctttagttttaaactacgatgaaaaatatcagtcaccaattaaattcgtttagcttttaaaaaagctttaaaaatgagcaaaaacataaaactcaaaaataaatatgttgggttgtctatttctaaattgttgttacaagttagcaaccttagcatgacccaaaagctataacacacatatcactcaattattaatatcgatattttaatattagtgcaaattttccttgtgaaattgacatgtatatttgcgtcttttttgtattaaattttgttaccaatcgacaaatcaagtccatgaagaaatttagaactcactagatattgctgaaatggtaatttagaaaattatacgtgggtgttacttgttagagaaaaacttgagagtttgagaaaacacttaaaagttaaaacggttaaacgatattcattggacattttatctttttatcttttaaggtttaatcacaaacgtccaagtccatatgactattttttttctttcttgttcctaaggaaaaatataaaatacatgatgttaaagtcaacgtagaatttgtcaaagtcagcctgatggttgcgtttggacctctttttaaccacagagttcaagcactaaaacatgttggtccaagtcttaatggaaattatttgttgaaataaatggctaatattttttttctatttattaattttcacaaaaacattgggtgccatatattttcaatgtacggtaatgtgaacattgagcggaaagtaccatgttccttcttcttttttggttttggtataattttcatcttctttgactcattagaatctgaaagaaaaaaaacaaactctcatctcatgtccataaaagaaattatctaacaaagaactcttcaaagtatctctttatctccttctttacttcgctcaccc

SEQ ID NO: 467 - DNA, 3000 bp, Arabidopsis thaliana
aaacgagaattatgattggaccgcttaaccataaccagccaaaatctacattattttccaactttgcttggtaattcatttattgttagctctaactctttcgtcgattataaaccccatatttctcactcaatcaataaaacaatctctcttttatttttgcaagaaatggatagagttctcgccgacaaccgtagacaatcgtactccaccggtcgatgcttgagttcgccgttatcttgtctcatccatacagaagaaacagagtacgctcgaatcagtaaccacaacaacaagacaagacctagtccgaagttaagggatttgatgagaagattattattggttagaagttgcggattggagaataataaatcgaaaacgttagttacgtttcactacgatgctgtgagctattcgcagaatttcgatgatggtttctatctgcgcgatgccgatgatgatcctaagctttttagagatcttccaaaacagagtccggatcactgatctatgctctgttttttcaattttatttttgtatgcacccctaagttctgtgtattacaaatgttccctatcgtgtacttttatttatttaagtatataccccaatagttttggtttataacatgtgtaccctatgtttttttctacactctacagttttgttggtttcgttttcttttagcatttgtttagaccttcttagcttgagaaaaattcaatcatgtttccatgttgcactttaacatctctggtaccaaataggcgtaattgaatcgaacaatgctcttatacttgtggttagtgttggttcgtctacgttatgctctcgtaaagttactatatgggatcctaaaacagggaggtccacatagatttaaaagaatatttaaacaaagttcagtgctagtgatctgttgaatggactcttaaaataaaccctcttttcttgaccgttgtttagtttttaaattgtgttatatttgtgagtgtaacgtttgaaacaaccaaccaaccaaccagaggctattgcaagtttccaaaccatgaatcttttgacggtttagaaaaagggattaaggcaaagaaatatgaggacatcactaaaagagtctcatagcatatcttccaagaacaagttgtacatctttatgcatcagaatcttgtctacttaaaagcttatctgtctctcttcctccatcgctacgaacctctatttgataataacttaattaacttgttaatcttgccattaaccacaaaatcattaaccttgtctctttccatctccctcaaatcaaattcagctctagcgaccgacgagagcttcaagcataaaactttttctttagtgaaaatcataattattatttttaaaatgagtttaagtgtcaaatctatattacgtgaaaacattgccgaacttcgaacaccgcaagacttacggaccaattaaggacgggatgcgtaggcgcagttagtttccgacgtttttaaaattttaacacttaaactcatttttaaaaagtaataatgaaattaatatgattttatactaagttttatttattgaaatgttttagtgaaagatttaaactatttaattatagttttaccaaaaacatttttttagagaaaagaaaaagaagaaaaagaatgaataaagaaatacctggttggatttggtagcaaagaaggggcccataaaaaaaagcccaccaccgtgagcccaccttgcgtcgtcgtcgtctgaaattctccgtcttcttcattcgtaatctgagaagcttctttgtctttgatgattgctttcttcctccaccatcgtcgtcaatggaaacgagaatcctttgatctctcctctcaatcgtctctctctctgtcgccatctccgccgtcgtcaatggaaacgagaagtcgaagcccaccgtgtcgtactctgaaaaatctgagaagtctcttttcgtctttgatcaaaagttgatcgtctctcatctctttgtctggtacatggattctttgattggggtttcttcctcatgttagagttcctcctaggtcgagatcaaaaccttcctaggtgctcttcgctttcactgcccccaatctcttccttctccgcttgtgttctgaaatcatcatcgattggggctgacatagaggatgtgggagaagtaattcaaccaatcacgaatcatcattcatcccgcgatcaggtattaaaaagagaaagagatgtttttgtttatttttcgtttctcgaagaagaaagaagatgaaggtgatttctcaagaatgaagaagaagaagaagaagagcgtgatatatttttcgtttcttggtttatttccttttttttctcttagagcagagtatttttgcttcattaaatgatgatttgatatatacttttattaatctaaccgttgaggattttcagttttatagaggcaatctaaattagatccgatttccatttactaatctcaatctaaccaataaggaaatttcgttttttttttttgatataacgtttacaagaatcaacttctttttgcttacaaaatttatatatcaaaagataagagagaacatgaatgatgaagaatatcaactccattcctaattttattcaaagtggtttgtttgtatacaaaacagagtctgttcctaacatatgttgtggtggttcttgctacaggcaatcttcgtttttggagcagaagccagattctacaggacttgcctgatacagcacacgttgatatcatcaggctaccgatgctggtctctgtgtcaaagagagaagcagcattgaaacaccaatcttatatgacattttaaagatattttaaagcgatgattttgacttatagattttaaagaatattcaaacaaagttcagtgatagtgatctgttgattggactctttaaataagccctctcttcttgaccgttgtctagttgttgaattgtgtttatattttttcta

SEQ ID NO: 468 - DNA, 3000 bp, Arabidopsis thaliana
gagaatacaggcagactgttcaccagatagcggcggaaaagagactgatcctctgttaaacaaagaggttgtcatgaacgtaaatgacataggagactggccaaggaagtcgtgtataaaaacgcactcagctttagcattcaggtcccgtcaaactatgttcttaatcgctacgttcgctgtctgttttgctgtctgtgcggttctctaccatccaaacaaggtcacacagcttgcagtggcaatccgaatgagattggtacacaaaatttgaatataagttcaacggcagagactctcattaacgtgtgtgcatcaaaaagctcgaagagagctgtaagagtgttcaacagagctcagccacaacagcttctcagagagtttcccttcagaaagagacaggatatgatcagatgaggtcttgctctttctgtgtgttcttcttcccaatttctataagaccggtgatgctgcaactgtaataacaagaaatgctcagatcagtgattaattatctctagtcgaatagtgttttatgtatattagggtttacttttgctcactgtaacctgttttttctttgtttcttggtctaagaaatgattcttgaacaaatcctaatcgtaactttatgcaattttctacttcaagcaatgtcttggctcttgagatctctctaaactctgtttggtcacctctattatcaaatgttatctttgacttttcttattattattgtcagtccaatagattaactagtactcaagtagcataataatttgagatggttttattcttttcttctctttttgaagtacaactgtattaagatgcatgttggattgagaaatcggcactgagattgattgcaacatagaaggcaaatgggtagaaaaagacaaagaagatgagatttgaaaacaacgaagagacacacatataaggaaatgcgtcagttctgagtcatatattttggtaaacgacaacattctaacattttatttatttgctttagatgtattcacctttctttaaacgtatcaaacgctagctttaacgtgctaatttaaacatagactaatctattttgcctttaaaagtttgctcaaacttagaagcatttctctttaacaaaagaaaactattagagattacttggacgtatgcaagatacaatctcaattctcaccgaaaaagtttgtacaagttcatttcacttttgcagtcattagttaggttagtatttttctttaaatatatgcatgctacgcgtggttgctgcgtttgttcaacagctaacgtagagaattaaattgcatttttttttcatttttttgtcgtagagaaattgcattttaattacgtctcattacctttgacaaaaaaaaaaaaaaatacgtcttggagatactttttatagattcatttcagtttgtcaattagttattatgttattataaataaaaaaatgtaataacacccttttttcctcaaatgtaataacaccttatatttttcagaagagaaaaatataatgctgaactcatcattatacccgcacaccaaaatgagtgatgtcatgcgttcaaacatatgatttggtacatcaaaataatgtccgaccgtacgtgtacatataatattggaaaatttagaacttgcgccaaacaacacatcacatgattcattgaacaaaatgatatgcacatgactcaaatgagttgtacgatagcctaaaatcactgttttaaaaatacgcaaaacggttatatcgatttcgtttgtaattacagaaggaaaaaaaatcatcttggaaatgtgctttaattaacggaaggtacagtttagttcatgtttattaatttgatgatctagaagtaagataacccgtcggattagaaaagtccatgcatgaaatcctaccaacggcatgaacataacgcatccacaaatatctttaaagacgaattttgatacgattttgcctttgttcagaacaatttagaggttagtagtgacagtagttagatattacagtatacaaaattacgtaataaatcataaaaagaaaccaataaacatgtacaaacaaatctagtatataagtacatgtggacccaaaaaaagcaagcaaatgtggacaaaatattgctgaagctcgtacatgggtacatgatcgcaatcactatggctagtttggaaaatacccacatggtaagatatcaacatgaaatccgaaatcagtttcaaaacaatttttatagatttattgtcagtgccggctgagatggtaaggcaggtgcgacagccgtatagtactttagtgacgagtaaaaattaaagtttgtaacccttccaaaaaggtattaagaaaattgtatgatcaattcgatctttaaaataacatgttttccatttcatgaatatcaagacttataaacttttgttgttttatataagttgatacaattgttttaattttatgtaaaataataatgaattacttaaacgtgaaaaacaacttcatatgttttgttcgatgtatacagttacaaattacattgaatctcacaagaaaggaaagtcgtagtattatgagattacattacttgaaagattagatataaatagtaatagtaatgtaaaagaacaaggaaaaacttattaggtagtaaaaaagaagagaatgaagtggagatgactaactctaggggtaaacatcagagccaagtcagtgagagcttcatcacagtccccacatgagaactatttttgtcagtattaatctcaatcattatcgcatttaatatttcattaatctattttgccgtcgaaggacaaatattgtaaaaatcttcgtcccatgtcgagactttacatacatctattacctataaatacctaattcacgaaccaaagtactcttcacatctatctctttctctctctttccttgcaaattttcagctctcaaagagttaagagttagagagagagagg

SEQ ID NO: 469 - DNA, 3000 bp, Arabidopsis thaliana
aaagctctttacatggggtgatggtgacaagagtcgtcttggtcatggtgacaaagaaccaaaacttgtgcctacctgtgttgcagctcttgtagaacctaatttttgtcaagttgcgtgtggacatagcctaacagttgcacttacaacatcgggccacgtctatactatgggcagtcctgtttatggtcagcttggaaacccacatgcagatggaaaggttccaacccgtgtcgacggcaaacttcacaagagttttgtcgaagagattgcttgcggtgcttatcatgttgcagttttaacttcaaggactgaggtttacacttggggaaaaggatcaaatggtagactaggccatggggatgcagatgatcgaaattcccccacattggttgagtcgctgaaggataaacaggtgaaaagtattgcatgtggttctaacttcaccgcagctgtctgtcttcacaagtgggcatcagggatggaccagtccatgtgttcaggttgccgtcagcctttcaatttcaagagaaagcggcacaattgctataactgtggacttgtgttttgccattcttgcagtaataaaaagtccctgaaggcttgtatggcaccaaaccctaacaaaccatatcgagtgtgtgataggtgtttcaacaaattgaaaaaggccatggaaacggatccatcatctcattcttctttgagtcgaagagaaagtgtcaaccaaggatcagatgcaattgacagagatgagaagttggatactagatccgacggacagctagctagattctcattgttggagcccatgaggcaagtggacagtcgatccaagaaaaataagaaatatgaattcaatagtagtcgtgtctcaccaataccgagtgggggctcgcaccggggttcactaaacataaccaagtcttttaatccaactttcggatcatcaaagaaattcttctcagcttcagttcctggttcccgaattgcgtcccgggcaacttcaccaatatcaagacgtcctagcccacctcggtcaacaacgccaactcccactctttcaggactaactacaccaaaaattgtcgtggatgataccaagagaagcaatgataacctaagccaagaggtggttatgctaagatctcaagtaagctgctttccacgctttaattcttgttccttactcctgtgtatttaggaaaaaaacatagctggtgagattgtgctattttgtttcattaacatatcgtttcattctttgcaatttgactccttttgcgaactcagtagtaaatgatttcacaggttgaaaatcttacacggaaggcacaacttcaagaagttgaactggaaagaacaaccaaacagctaaaggaggcactagcaattgctagtgaagaatcagcgagatgcaaggcagcaaaagaagtgatcaaatcacttaccgctcaagtaaattccaaagtttcctctctgctgttaaaatgaatgaaaatgctctatgcaacttactgattttctcaataaaacatgcagttgaaagacatggctgaaagactacctgttggatcagctcggactgtcaagtctccgtctctcaattcatttggttccagtcctgattacgctgccccttcttctaacaccttaaaccgtccaaacagtcgagaaactgattctgatagcctaaccaccgtcccaatgttttcaaatgggaccagcacacctgttttcgatagtggaagttaccgacagcaagctaatcatgctgctgaagcgataaatagaatcagcacacgatcaaaagaaagtgaaccccgtaacgaaaatgaatgggttgaacaagatgaacctggtgtgtacatcactctcacagccttagctggaggtgcaagggatctcaaacgtgtccgtttcaggtaccagaatgctttttttttgttttatagtcttagctggaatgtttggatgctcctttttattggttatgaaatgagcttaatccgaggatgtctttgatggcagccggaagcggtttagtgagaaacaagcagaagaatggtgggcagagaacagaggaagagtttacgaacaatacaatgtacgcatagtagttgataaatccagtgtgggtgtaggaagtgaagacttgggtcattaatattcttcgctaacccctgataacacagaaaaccctgagtttcccactcatctattcttttttagtttctgtctacgggtttcataggtttatttggggattataaccaagagagaaaatagttttcatcatagtttgggtgtttttcatatgtaaattcttttgtaaattccacaagcatacattgtttcgttctttgtctcgataaatgttattatttgatgttgaaattcaaacagcattaatggtatggtgtcagtgcgagcttatacattttagatgtctatgggcaaatttaaatgatatgcttcttaacatcataatactgtatttttttaataggcttctttttttaacaaaatcatttaatgcccctttggtatatacaaattattacgaatgctatcttaaatgcaattaattttgtatcaaaatctattttcagattcattcttttgacatcatgaatttctcatgacggaatacaattagcatgttgataccattggaaagtacattttagtaatgaatttaacacgttacctttttgtttgatacaccaatactctttattcctggtcaaccactaataccgtttacatatatgtaagataaatttatcttatacgataaactcagcaaaatcaaacaattaatgaccaaccaaaaagaattagatacacaggttttgaagagttgcaccaacctctgcctaccacattaaacacttgtttcttttgttggtcgaccaattctgaaaaaaaagttttactcatacataaaaagcattagtagacctttttgatatgaagaagaacaacaatactcatacc

SEQ ID NO: 470 - DNA, 3000 bp, Arabidopsis thaliana
atttatgaatttatggaaccaagttctggggattcacaacatgacaaaaccgaatctgtcggaatcgtttactaagggaatctgtcggaatactaggctatcggggaccaaaattcttacctggagaaggagaacctaacatacttttgctagattgtcccattgatgtctctgctgctaggattcgagagggagtggattactatggaagcttttgtagacagcttcgttcgtattctgttttttttggatgggcttttgcgagcccagatccgtgaatgttgttggtgttggatttcttcactcctccgaaatcggcccattattatgtttaaggcccaataaatttggaaaattcattagattgagttttgactaacaaaaaaatttgatctaaaccaaatcctagttaatacggtttagtaactcgtttagggaaaatcagctactgtatatcttggctttggccggtttagtaaactaacttttgactttctacttacttaaccaaactaaacctaaatcggggaattcaaactataccataaatatggaggccggaaaaaaatcatccaaaacttggtcaacgctgagtccaacgtggccatcagccttcggcgaatgattattcgagaaagaggaaaaagtgagtcgttttaggggaaactgttaccaacgccgaaaaacaaatgctttaactcatcaccggaacaaatctgactcaacttggtttgttacttacctgggcggtgttcacggtgaataaaactagtaaaagtagtaactagttatgaggttacgattaaaaaactctttttgggacacaaaacaaatttatttactcaactatatcgaaactgactaatgtgggttacaataatatagattttatagatcagtgttgagaaatgatcagcataacccttgtcgatcgtgtttagaatgcgaacaagtatgttaagatacaaagaagaatataatagcatcaatgatttacgtaccatggtggcaaaatattcttgtgaatatataatggaataataattatatgaatacttgatccaaacaacacaacatacgaatttggtgtcaaagatatgagatggatatttctatatgcgataaatttgtaaaatctaaaagttgtcgattaaatttacgactttgttaattttaatgcatttttggataaaaatatattcaaaaattagaagaccaaacaaggatcgctaaggaaattttgaatatttttcctttattataagcttcatttcactagataattttcttattattcaattagacgagtatcaatacatcacacacaaacaacaagaaaaaaaacaaaaagaactactgtttcttgagaagaagagggccaacgttatctccattagctttgttgtgcttcacatgactcccatcacacaatggaaacgtccccgacctccaacacctaaagtcaaatcaaatccatgcatgaccatgattttatatacatgcacaaaaatacttattcgtacatttgttcgtttgtaaaaagactactaattaagaaaaatcttacgagcagaagctttggcaaaacatatggattagtatgaagatacattaatgtataaatcactactatgcatgattttaattaaaacatgattcaaatagtagctaactatgttcttttctttcctaattaataagagaatgtgaacctgcaatagggagttatgttcttggaaagctcggtgacaacgacggagtcaacaaccttatcttcgttctttctgatctccggattgatacctccaccgccttctgctctcaccaccaccattctctgctgctttcgtcccacctctcccccggtgactggcttgaatggaagctccccggcgtaacttagccccgtgccgaacgtgcttgcgatgatagccattggaataactctctcttactcactctctatgtggcagtgatttgtttatgaagtaagacagaagatattagatatatgaaaggtaaagggagagagagagcttgtggccatcacgctccctctgctaaacgacgtcgtaaagcgtgtgtatgagatggaagaatcaaaagatatggtcacaaactcacatgagatttaatcacaaaaatatgaaaaatcagctgcaaaatttattttttacttacatttagaatttacaactttttaatgttcttatattatattgattcaaattaatacacatagaaaattgtgtataacattattttaaagatgaaaaacactatttttaagatgaaagaatacacatatatactgtatatcttttctaatttttgttctcaaattcgtctaactaagtaaactattatgagaaatagttccatacataaaaaatttgcaaaagaattcgttgcaaattttaaaatagtaattttgaagtatttgcaaaggatttggtcataggctaaccttaactcttttttttctaggttgttatttaaaattttgaaaatggtatatattcacgatggtaaaattttttcaatagatgaaaattccaagaggatgtgttaatagatcaaatgtataaatatttttgagtatttctctgcacataatttcaaaactgagaacctaaaagtgaaacgcatgacgagaattcgagtcgaagtgtcgaaccaaagcttgtatatattgccctagctgtggaattgcttcaaaaatgagtgtcgtgcaaaacggactagttctcttctctctcacgacgagactttaataagaacccaaaacaagttcgcattgacacgtactacactaattaaacaacaactattaacaaccattcaacacaaaaactctttcccattgattcaatttcaaaattttggatctaataaaaccaaaactctcattaaaaaaaaaaataaaaaaatcaaatctgatttctgaaacgtttttgattcgcgacgattcccaaattcctgggaaaatatctctgatcg

SEQ ID NO: 471 - DNA, 3000 bp, Arabidopsis thaliana
tatagtctttaaatttatggctgtaacaacagcaggagggtgaaccaccttttcctctgaaactaaaatagtgatatccttgggagattgaacagtaacctcaaacttgcaccaactcacctgcacaagtggcaagtcctctcattagcggagataaacagaactagaaaaatcactgattatatgattatggcacagatttaaggtcttactccttccgaaggagagcaagtagagaagcttgaaattttgagccaacaaggtcccatgatcttcctcttaaggataaaatgctccaaagcactgcatatgaattaactttgataaggatgaaaaaattgcaccgtgctaaattgacatagccagcatacatagttaactaagaagcttacagaagaccagaaaatacaaacttaacaaaccaactaccaaacacatggaaaggtaatgaaactcagcagtaagaagctagaacctggtatgagacccgagcaaagcggagaaagactcgcctttaagatcttctggaagtggacgatcctgttataaaagaggaaacttgtcatattgttgagatgtaagaaaacagacgatttttagttttattttgaacagctgaaatgtaccttaaatgaataatttatcttcaaaacatattgttcgccagcaggcacatcaggcctctcaaaagcatagtttctctgatattcgtacataaagagcagaatagagagtcaaaagaaaagtattgctgctagaatacatgaaaaagaagtcaaatatccaaaccttgacaggcgccatgctaaaatttgaaacattgagctgtaacaattcctgagcaatttcgtttttcagttttgatgccatttcctgagaagacacagccaaaaacaatgaacaacagaggaaaatagattgcttcctcttagcatgtaacaaaggtagtcaaactcacatgcaatttcccacggaaggattcaggagaaagtcgagagtctttcacctcttgctcgagcatgattagttcatgggaaggaaatatggaatcatttggaatagcataaacacacctctggatattcttaactaccacacagcaactcttgtaagtatctcccattttaacctgaattgttaaaaaaagagagaccgaattcattctctagattaaggccaaaagaacaactttaaaaatgaatgaaaaatctagagattcaccttcccaaacagatatattgtgcccatgctcgcaccaaaagcctcctcataagcgtcaagaatgaagaaacgaagtgatccgtcagcatccaaatcaaattccgttttcccttcagaactagaaccaagcaaagccccattctcagttccaacttttcccatcgcttccttccaaccagcagtggcacttaaagccgaatccttctctttcatatcaatcgttgcattcaatgtaaatacctccttgacacctaactcactcttcacttcagttttccttatcttgtttgatccatcctctttgacaatatcacttccaagtaattccatagtctcagaaggaatgacttcagattctttcatatcttcctctttcatcaattcattatccatggaaacagaatcaccctcataagttgaaggtgttggttcagactctttcattcccatactcgaggcaacagaaaacagttttttattcttgaagatggtaactggaacagtacctggtagttttctcctcgtatgcttttttctatccgactcatctggagtaacctgagctattatctcgtcaagaataccctcatactgtgccttatcagtctccttaactttcttgaaactcgaagatgtgaacatagacgaaagtctaccttcaccagtgatagtagccgcagcttttaacgccggattcaccttcttaacctgaggttgctgcgtttgctctttccctttcttcttcttcttaagtctcccactaaacctaccaccgtcgtctgattcatcagtcgattctggtccacttggcttcgaccaatcctcctcctcaccttcgtcgagatatcccaaatcgccaccttccccatcttcaactacaaacccgcgagcctcctcgcgccgccgggaaacaagtgcgtcgtactcttcgtcatcaacggtatcgaagattggcttctgcagcctaatatcgtacccaccacctgacgcagaacggattcctccttgtcgaatcgccttcagacgctcgagtgtgtctttcctactcgacgcctccgcgcctcggctacgtcttcgtccagtttccgttgaattatcgccggacatttttacaaatccggtcaatttggtggtttggtgaagctgagtaactgatttaggtttaagaacccagattaagaaatggagatggcgggaaaatcgacacgattttggcgctatccatttgccaaatccgaatccaacaaacaaacgggttctcttaatgggccttactcctctttaataaagcccaaaaacaaaaacaaaaaagaagcaattatgagacatctatttgaacgagatcaagcatcagagagttgtaggagctacctcggtctgtgaagtaattgctgatggagtccaccaagtgtagaatctagctaaatacagtaaaagaatcaaagtttcagcctgagttctaagttactgatatttaccgattcgaaagtctaaactattgctgaaactactaataagttcatatccaaaatcattgttctctatgataaagcccaattgaaagagaaaagaaaaaaaaacaatgatgagagatgatgtgttgccgaccacctaaaaccactttaacaaaagcaaaagccaagtaaaggttacattctctgcaacttttttgtcataataaaaactaaacatctattaacaacaacactataattgtttcttactaacaccaaaattcatttcactttgaagagaccagagaaaaaaacttgctcagac

SEQ ID NO: 472 - DNA, 3000 bp, Arabidopsis thaliana
aaattgtcacagccgttttcgatgcacatgatccgacaaccattttggttgtaatgatcctgaaaaccttcacactctcattacataacgtcgcaaatttactatacaaccatttcttgacaaacaaatcggtcactagctattcttctgttttttttatttttcttgtaatatttatatatataacgagtgtgacttgggctttgacaatgttagtatagctttaaaacgggggaaaaaaaaatactagaacattaagttttgagggtgcaaatatgtaacatatgtgttgtagaaatactttttaaaatttcaataataaccttggtttagtttccattgtttgaattggtattcatatctgactaccgtagaattcaatttgttagtgcagaatctgaaacagaaattgtgttgtctgtatattctttttttgggctctcaaatatttcgtgtatttttgtggaattttatataaagttggtgtcttttttaggacttttcgttgcattcaattatgttgaatgtgtaaaagtagtggctttccttggtcacatttatcaaacgtgttttcgcctttctttaattttccgtgttcaagtgaattctagctaacttttcggttttacgttgtatgaaaataattggctgtcgtcggtcacatgatcacatagagtttatttgattcaaatccatttaatatatgctgtatctttaatgcatacatagagatatattattatacgttatcttttaataggacattatattttgtttatatgaaagaaaagaatgtactgtatatgcagttatattatgctggtttatgtcaaagatagaagttaacgcaaattaatttctttatttcaattgtgttttgcgttacgatctgttttttttttttttggacaaatgacttaagattttattacttcatttgatattaataaattagtatgggtgatgcaaacgacttgaaggctagggttggtaccacggctgctaaagtctacttttggttggatctgtggtcggaagatcttgacgtgatcacttctataattgaggattgtgtgttgctgctactctcctctcacgataactcacgtggcctttttcttgtttttctttcttcatattttcacaaaacaaaatagtcagagatcttgagagattttttcagaagcatattgggcccaaatgtggacaatttcatgtggttgaattgttaaatttcagatagattagacaactaatcttgttgacgtgcatgcggtgaggatattaagtcgctatacgtcatatacgtgtatacttaaaatctcgtttgatatttctttcttttgtttttatcttcaacgacaattattgcctcaggcatgtcagcagaaaacgacaccgttcatattcgatctcgttattaatatgtttttgaagcaaaatatcattattagctatggagtttctgcagtagcctaaccggaagtctcaaaaagataacgtttatgccggttataattaaatccgataaggcgataaataagtgaacccgtaaagtctaaaattttcacatatatatgaacaaagaaatagtctatagatctccatgcattcttgtacaaacatatttaattttttattttattttctttatataagagttggtgtatgaaactttacattttgtaaatactaacattacatcataatgtcagaaccaataattctagtggaatgatataatctccactttaaattcttatgtctttatccaaagagatcatgaggaacttgagcaaaggaagagggcaccgtttagtagtataggtgaataacgtggcggacacgaggctggtctcattttcaaataaagagagatagagagaaaatggaaggaaaaaaaagctattggcgatgttgatatttgttcgtcttttagtggagacgaccaagagattttgaaaggtcgtcgaggagttagtttattatcttacaattattatggatttcttctgactaaagttttagtgcaatagttttctgagttattatatatttttcgaaattcatccaaaggctaaaactttgtaaggtattctgagtctattacgctagaaatagacacgcttacgtttttaagtcattttaatctgatatatatatatatatatatatactacaattttataaccaattatctttgtttcagacaatttatataaattcatataaactatcagaaataaagagacaattggctgtaaaattgtattattttgcatctatgaaatttttatttctctttatcaaaattgaagacgagttgaaattctatttcttttttaaaaaaatttatatatgggagtgtcaaaaaataattttcctttgtaagagaatattcgtatttggacgagtcttgatttgtgttttccgttagcgttccacattagttgtaaagagcgagaaagatttaagtgataattaaaaagacaagatatgcattttgaatatactctagatattaatcttaagcatttttcatattggttatattttatggtcgaattttgacatccgaaaaatacatcccttattcttcaatttatattgaatacttaagtttttgatagtaaatatgtataaataaattttaaacaattgtcaaaaagacattataacttatacggttatagttgttaaaaaaaaaacttatacggttataccaatagataaactgacattttagatttgagttttttttttttttactttccatgtagatagcgtggaataatacctcatttatatgtatcgttagttgaaataattgacaaaaggaaactattcgtttgctgttctagataaaagcctttaattgagaaaaagaaaatgcctccagctttgacccgttttgcctataaaaggattctctaagatatggactttcctcatcttctcgggtaaacagaatcaactagttttgtttttcctctttcaaaa

SEQ ID NO: 473 - DNA, 3000 bp, Arabidopsis thaliana
ttatcgtgattattattctagtctatatatgttaatatacatgctaatgttattatgattgtaatttgtaaatatatacatgaatattaatattctacatgtaagtgcaaaaccaggatgcaaataaacgatgcagtgacaacaaccaacatcttaatcatttttgtatatgtcattcaataccacaaaaagcatttttcaaacataacattatattcaaacgtcaggcggtttacctaaactgctatgtaaacacttcatttcggtctctcctcaatcagactcaaaactaaaactttgaagaggcgactatcattgtcaaatcaaattgtatttcattgattcattcgcctttgaatgactaagatacgtcacacgtggattacttacggttacgattaattttctttctttttgttggtaatattctatgtttaaatttgtcccatcatttcatggggtgactgtgactaatcttctttggcattttctacgtaatcaacgattcgaataataatcttcaatatatgctgcaaagagtgtattaaaattcttactagcaatttacacacactaacaactttttccaattcttgactccggcaaggaggttcatatctttttcttaatttcgaagctgtttaccaattcaagtgaccctaaattcataaatataaagaaaaatggttcaaatcattaattatcttgttccttgtacataaagcaaattcacatatatagtggcattgacaataaggattaccaaatgtatataatttaatgtgataagcaaagtttaacttaaacaaaaaaaaatcagaaataaaatgtgaataagttttgtacaaggtttaatgtgataagcaaagtttatactaaaaatgttaacaaacgtgattatgatcttgtgatttccgaagagcataagttttgttcaaatggcccaataacaaattaaaaacatgtaaagtagtcagtttaaacaagcatttgcataaagtgtggttaatattatattaaacttcacatccaatgagcattcatgtaatttaaagtaactgaagttaagtatctagaagcctttttcttctattggttattaatttgcttaattttctttataagttaatttctggttggtgtgaaaatgtgaccggagaaggtatctaacttttttttttctttaatgaattccactaaaatttaattctgtatgtaacgcatatagtaaaatctagaaagcgaccggcgtgcctcctttggaaagtaatcctgtaaaagtaaaagccgcgtagtgtaaaagtatatgacttcttcttcccataattattttataattagtctttaatctaaatatttaaacatataattcgttttacgagaaagatcttcacactcgattagtatacattacatttaattccctagttcataaaatggataacaaaaggctgtgcgagattacaactgtacttgataattttgtataaatatatcctttatgaatatattttagcattgatgaccgtacatggttaatccagtctgcagcataacggagtatgatattaaatgaacactttctgttcgtatcaaatggtatcgaatattattagagtgatcattcagaagaaaaaaagagagagaagaaaacctacagtgtaaacatttttttttttgctaaatacctacagtgtaaacatgaagtgctataatttctgcaaatagaaatcaagaacagaaagagttgcttggaggaaaagaaatagaaaattaagaaatctagtgatgtaataaatctttccataaaatcaaatgtttggtccaaagtattagttaaataattaggccactattcttgacaactctttttaacaaactcttctatattttctcgtggtacatatgctgaaaaagatgtatgtctaatccataatatatctgtataatgcgactttcattatctattagtacgacttctaacctagaagataacaagcattagttagggcatcaaaatcaacgtggaaaaacctacgaaaagcacgaagtgattaatctgtgtaggggtggcgtaagggtaaagactaaagactgagaatctagggttcaaggcgtaaacttgttctgctttttgggtttcattttattggcgaacaacattgatgtgtgtggaccatttggtgttcagggattgagacaagataatatgtttgctctcaccttctaggattactcgggtgctaagactcacttagtactattgctatatcgatatactagttcattaccaaaaaatggagtcttcaaatttcgagttccaatatctgaaagcattgtttaaagagatttgttttctccctgcacaattagtttataacttcatatatacacaatcttatcaatttacaaccaggtgtgtgtgaaccttcacataatctctcttattcattcatgtatatatccaataaaagttcgatatgtgaaattatatatctccatctaatgttagactatttccgggtcttgactataaatttaaagtattagacgagctaattatatttagcacaaacaatttcttctgtaacagtgtcacgcttatcactaccaaagaataaacactgatctgttttaatctcttattttctcacccatattcaaagtcaactattgcaagacttcgagataattaatttgatggctatactatttacttgacatttgggaaaatatattttcgctgataaatttggtttttacttctctctccgacggatatagaaacaattcaattacatgcgaaaatgataattcaaccctataaaccaaaacaaataacagaatgcacatttttttcaacgcgttaggtcacctatctttcactttagaacatcccttcacgtctctatataaacctcgactctgttatcctttgttcttcaagtacaacaatcaactctaagtctattatattcaagtctttgttttaacctaaca

SEQ ID NO: 474 - DNA, 3000 bp, Arabidopsis thaliana
ccatttcaatttcatttacctaatcactatattgaaatgtgtctctattgaagtatatgttatatgtgtgtgtttatattatttgatacgcgaaattggcctacttttccttgaatgatgttgctttcttaccttcttataacgaacagagtctaattatgatatgattggagtcattgaaatagataaaattgaagattagtagttgaattacctatcgttatcgttgtgccacaagcaggctataagcatcagatttaggtgaacccgcttaattttaatgaatagtttttggtgaacaacataaagcataaatcactgtcattactccataatcatataatatagtttatgttctcctcctatatctgaattatggaggaacgagtctgaaatttcttaacaaccaactaatacagccgtcgattaaacaaaaattgatattgctgaaaacgtgggagtgtcaaaggggacggagacgacccggaagggcaaaagaagaagagaagagttcaaagggaagggcaaattcgtaattaacaactctctgtgtgtgtatgggaaagaagagtagttagttaaacgtgcaaagaagcagcctttccattttcatttccgtttccaaacacataaaccgcaccaatcaaacaagctctggtttttgctcatcgatctcacaatcttttcgtttcctcgcaaaccaacacctaatttcttttgatccacgctaaaacaatccccatttcttctgatcaagatgtatcaccgtcttccatcgctaatggagccgtttctacggagtgtctctgaccgttggccggtcatcgctcaggctgccacgtggacggtgcttctaatgttcacggtggccgtcgcttcgtttgctccggagatggcttttgtgtctacggtgtcgtcttcgtgcggaggaggagatggtttcgtgaagattccgatggattttgcaggggagagtatatgcgtgccgtctaatatggtgaagagatcgcgttttgatttgtttgtgccttcgattttcgcggcggttatggtcactgcttcggcttgtttgatccgatcatgtattggcacggagaatgtggatgatttttaataaacacttgtaaattaattaataatcttgtattcagttactacataacatccaccattttgttattccaaatcacgacattatattaagctgcgtcgtagaatagttgacatttgtcagtgttaacccaacaatttgatctgttatgttatccacgacccaaaatcacaactaaacaatttgacattccgttttgccatcgtccggttttaaatcaccatcaaattagtaattagtcaagtgatcatgacaaatgccgagagatacaggagacatttgtgtgattctgaggtttgtcaggtttgcaaagggggagtggagactatcttgcatgttcttagagactgcccttcgatgtcgggaatatggagcaggattgttcctaggaggaaacaacaagcgttctttacgaagtcattatttgagtggctctttgagaatctctgtgagcaggttaacgtggaagaggggccttggtccacgatgtttgcactagcagtttggtgggggtggaagtggaggtgcggtaatatttttggtgagaatagaaggtgtcgggacagggtacgctttgtgagggatttggcgaaggaggtttcagcagctaatcaacagttggtcactcagggaggtcgacgctcgcgcgtagagattctggtagggtgggagaaaccgttgcttggctggttgacagttaatacggatggggattcgcgtgggaatccgggtttagctgctgcaggaggagtattacgagatcatgagggaaggtggtgcggaggtttttctttgaatatagggagatgttcggcaccaatggcggaattatggggagtttattacggactccatttcgcatgggagaggaaagcaccgcaggtagtgttggaggtggattctgcgatagttgtggagttcttgaggacagggataagtgatcatcacccgttgtctttcctggtacgattgtgccatggctttttatcgaaggactggatagtccgaattgttcacgtgtatagggaggctaatcgtcttgcggatagattagcaaactatgctttttctttagcttttggtttgcactttttttactctattccgaatgttgttgagttactttggcgagaggatgaccttgggatagtttgcccaagacagatcccagaacggtaatttttagttttaagtttgaataaaaacggggggctctttgccgcccggtcacttaccaaaaaaaaaaataacctactttataaacattttaaccaaaacgttttgtgacctatcatgataatttggtctgcaacatatgtcaacgtaaagtttataggcccaaagacgatcaatattagaatgagtagtagcacttatacttgaaacagtgacccattgggcttaaacagcatctttttgaatcactggtttttttaattaataagaggagttatcagagagacgtcagagaacgtccctgcgattgcttgcagcgggaagtttctttctctctagctccggatttgctttggtatgttactacttcacaatcttcaactccattgattgtatccttgattgcgatttgctcctactatgtaatcgttctcttgtctcagatctaaatttaagctcatctttgaattttagtctgggactgagattctctctatagattcgtcgatccagtcttattcctttgtaatttgtttgagatgatgatgattatgttgctacagttttataattgagtatcttagagtgaagtttttctaatttctcagctattcagaggatctaattttttaataatttgcagtcgaaaaccgtaagctttggcgagtttccgggagaatttgacgaatctgttttgcaacgagtgagaattc

SEQ ID NO: 475 - DNA, 3000 bp, Arabidopsis thaliana
aaaagatggctcctcgtcagaagaaacctaacaagtctgatgatgatgatgatttgcgtaggaagaaacagagctttttcaaacagagatttccaggctttaagaagaaagcctctgagctctctgttctctgcggcaactctgtcggtttcatctgttacggtcccgacagcgatcttcatgtttggcctcagtctcaagatcataacccacaagccctacatgagatcgttgccaagttcaatgccttgagtgatgagaggaggaagaatcatgcatgtgatctcaatgacttccctcatcatctcaagggtttgtctcgtgaggagttaaggaagcatctccttcaccttgactctcaattacttggagtcagggaacaaaagatagaaattcttaagaagacgctcacgggttcttccgaaaaagatggtgctagggtttcagagaactcggccatctccgatcacaagttgaagatagagcctcatttgaaggatatattgtcggaagatcatctaattagggtttcagataagaagctgggttcgtgtgatgtatttgacgagttggcttacgtggtccgcgggtcaaggaatttgaacgagaatgtttccaagtacgaatcaaaagatgcagataacacgggactggatcatcttgtaactttaggcggtgattatcttcaggaggcggcagcagaactttaccaaacttacaatctagggaatttttgtgatgatcatgtttgggatctggagtttgcctcaagactaccactacttcatacttttagcgatcctctcatgaccaccaatacttgccaaacgatgagcaccgatatgatttcaatttgataacttgatgactacgttagtgaaacatgtttctttcaccttttctcggtgattgatcattttttagtatctaaacttgtatgtttgctccaacacaaatctatttttgtaaagttttggtagtgttttcttgtttattattgattaatcaaacttttcctttctttctgttacttaaatgctgggcttgatagtagtataagaaatttgtccacaaagcacaccgcaaagttccaaaagctaaaacccttgtaccttggagtctctgcatgtgagaaaggaatatgagagttaaaaagagttttttcgtaagacaccaaatcatctacaatgacgatgagcgcaactttctatcagtgagcttgcaagctagcgttcttgacttcagaaatgtgattatgattaatagttgagttaatcttccttaccaactttaaagaaagaaaacaatcactatgtcatacattcttcaggggttaaacatgtcggatatgaaagtaaccaaaagaatcctcattgagataagcaagtaataccttccaacctgcgaaattgttcttgtctggtgattctaaacagaaagaatcttattcttgttttagctcttttgttctagactagacactagtgaaagtgaaatttcaagaaaggttacaggatcataccttttgtttggtggaaacagaggattctgaaattcctggctgtggtcacatacatacatcaatcacatatttactagtttctaatgagaaagttcagcttggattcagttcatcttctctcatctttaaggtccgaactatgtccaaactttggcaatatatttcaacaaagactctaacattcttatatgtgagtatgtgacgttgtatctcagtaacttgctcatccaactctctgcgaatattcagattcttgattcaggagctcccaaaacttcggaattccaaatgacgtacacaattgcctaaaacacaagtctcctgcttaaccatgaatagttgagtgaatcaaaatctcactgaacaacgttgtacaagaaatcaaagttcacgatcaaacttacaagcatatccatgaagataaatgagcgaaaactaattacttggcgtatatatcagttttgacgtttggagctgggaagaaaaatgaaactgcaaatcaaataatgtcaccacattaaattatttctgatcgtgtcattattcaactgatagctgttattatttctggtcaacctcttatttgttgtctcttagtaaaagttttcttctagattgaacaatgttttaaaattttgacaagaagaaaaattaattgtttaccgatttaaagacaagaaagatctaagttagtgtatatttaattaatgcagctttagttttttttgttatttggtattttgtcaacaattttttttttataatataatgttcattccacgatcttcggaattgtgcacatccgtcgttcaccaacataattcaaaggaaccagccaattaaacttagaaaaatattgatgcccatgtcacaacaacgaagaccgttgaaacgacggtgttttacacagccaacgaacaagtccagcatggcggtttttgagaaccaataagaaattaaatgtattgtttactctctagagtaaatttattaatttttaaagaattcataatattccataaattaataagtttactagcaacaaaaaggtctgaagtctgtatctgacgatcacgcggcctaattgcgcgtggcaatttcttcaacgcggattttttttttcctgccatttcttgcatcaacgcggattaaaaaaaaaaaaaaaagtgttttcggtaataacccgaaagagaaaatacgtatcggaaaaaatgcaaaattttcaaaaacatttaattttaattttaatttcaagccaaattcgggagcgactttccaaagacgaacaaagccattgaaacggaagagaaggctgctcctttggtcctctctgtttctaccgtcgattcagatctctgcctctcgcaatcgaatcaatttgtgtaacgaatcgacgcgaattatagtggtgaagaagtcgacaattcgattgttgtgtaagttgacgagaggattggatcggtgtgaattcctcctaa

SEQ ID NO: 476 - DNA, 3000 bp, Arabidopsis thaliana
atagagcatcaaaacctaaatggcttctagctcttgagatagtcacagggtcaatggttggtttgctccttctggttgcacttttctctgcagttcaccgctggaacaatagatcaactctcatcattccttggaagaaatcttcaagtgaaaaggaaaagttcacagtctacgtaggttagaatctttcctaattctttaccttccaatgtagaatccatggagcaaagaactaaaaaaacgtggcatgtttttattttaactacagattctgaaatgctgaaggatgtttcgagattaacaagacaagagctcgaagtggcgtgtgaagactttagcaacatcattggtttatcagcagatagtcagatctataaaggaacgctgaaaggtgggtctgagattgcggtgatctctctttgtgtaaaggaagaagattggactggatatcttgagctctatttccagagagaggtagcttcctctcatgttatcatcatcaccaagccacttggattgaacaatctttaaacatatcctccttttttctgagattttaaatccatctcctcactgtttcaggttgcagatttggctagattaaaccacgagaacacagcgaaattacttggatattgcaaagagatctcaccatttacaagaatgcttgtttttgagtatgcatcaaacggaacactatatgagcaccttcactgtaaatagtctaacttacctcagagctttgttgcatcatcctgtattgttttagctagataacatttttatgtgaaatattttgatgcagacggggaagcggcgttagtatcgtgggcaagacggatgaagattgttataggcatcgcacgtggtctcaagtaccttcatatggaacttgatcctccgtttacaatctctgagctgagctcaaacgcaatttatctcacagaagattttactcccaaggtaaagtaaagtgagacctgcttgttatctgagtaatacaattagctaagctaagctttatgttcacattctttcttttttctgactttctctgatgcagctggttgatttcgaatgctggaagacaattcttgcaagatcagaaaagaatttgagaaatattagtagccagggttcgatatgtgtactcccaaacggaatggagagccgatatcttgatgtgtcgggtaatatctatgcattcgggattcttttgctggaaattgtcagtggaagacctccttattgcaaagacaaaggattcttaattgaatgggtaagacaaaaacaactcagtttctctaaacacttgaaactgagttacttcctcctcctcttttttcaccatttatatcaaaaactttgttactgttagcctagtaggaatggagtcgtctgttcagggagagacgagttttcgtctggatgtggaagtcttgaccttgttcacatgtttagttatatcgcacctcaaatgtggtttttgtggcaaaagttttgaatttgaaacgtatctattgcattttgcaggcaaaggagttccttgaagcaccagaggcaatgtcgggattggtggatccagagctgaaacattttaaccaagaagatcttgagacggtatgcgaagtggctagccaatgcttgaaccgggacccaaccaacaacaacaacaatcacaacaagccctcagtgcaagagctatgcgagacattggagagcagaatcagtctgtctatttcagcggagcttagatcatcttctttggcttgggccgagctggcgcttgactcgtgatgagaatgatgaaaggaaagaaaacgagtgttgaatgatgcaatgctaactaactaaaaaccaaactctcaactctgtaaatcaatcgactgattacaacatttgatattgtttttttttgctctgatcttgacgagtgtgtctgtgttcttgattagttttgagttttgggtggttcaaagtgtttgtaaatgaagagatgaacatagtttctgaaagattttctctattatttgaaaatctatgagaggttgaagaatgttaatgtagtgtgtttggatctaacctttaatcttatattatatagagcattgtatctattgtttgacatgattagtctcattggaaaaagcttcaaggcaatcaatttgagatcaatatcagtctcagacaagtgtttgcggaccaagaagaagaagaaacgtagttgaagttcataaatcataatgcatggatcaacttaataaaaggcccacatttagcctcgtatcagtctaaatgggccacacaagtcaataggcccatttatcaatgctttgactgttttcaatcttcaattttggtatgacttcttcttacgaggttgagtgccataaaagattagacagacacgtaaaatagattccattttacctttagttaaaacagatatggattagccaagtttcgttagtatattgtcatattattttattgaaacagaaaaaaacaagtaaagattacttaatcattcttaatcaggcctgttcttaattatcaaaaaaaaaaaaagattacttcatcatgtcgtaataatatcactaatcaatccttttttttttgtcatcactaatcaatccatttttttagcgaaccttaaagtcaaaggtgttgttactttggacgattaaatttgaattatataatttaaaagaaaattggaatttaatctgttgaggttgaaattctctctttttatatatggcggttgaaatttaaaagtaaagtattgtttggtagggccctatagtttaaacatttacaaatcggcccacacatttttgtcattttagatgtcgtaaaccgctttccctcgtcttcgttccaatttaaaaagcaaaacaatttcaaaaagtctcatcatttcccataaacctaaaagctttttaaaaactcaaattcgatacgagaagaacaagattcgcgcacaagacgatcgattac

SEQ ID NO: 477 - DNA, 3000 bp, Arabidopsis thaliana
agtgtttgaaagagaagctcgaggggataagagcattgttagatcaatcagagggaaagattacggaagaattgaaaatgaaacttgaagatgaatcaagaaacttgcttgacaaggtaaggaagatgattatttgatcctcttagttagtattgtttttaatattagtttaaaggaagacttttagctcttaggagacgataggtgtcaaaacctgtgagtgagactattttgtgcagacaaaacacaaaagcttgtaacgtgataaatttcaaggcccaatgggcttttgatctgaacctttatggaatagctggatttttctgtttttctcttgtcggcgagaatataaacctaaagagggtaacccggtaaaatgagtccgagggttacactttaatgggcctttaataagcccattaagtatctataaataccgtacatgattcttcgtctttttcatcattcactgaaacaaaaaccctaattcctatgcttctttctccgccgcttctctgtttttggctaattagatttcgttttattaggaactctgttttggcgatgatgatcaatgcttaatttctgacacctcttgtatgagaagagcttgataacctcttctttgagcacattatgcaatactctgagccttaccaatgatttttttacaaagacaagttttttggatctgaattagggtttaagagtgctatgattgtaaaagtaattcctcgtactgaaagccaatggcttgaaagactcacattactacccatagaatatgagcactcactcttctaaatccagttttggttttgttgtttagcattgcaaagttgtggctttaattctttggttttgttttttagcattgtccctttgtcttttaagagccatgttttgaattgttgttgatagaattagtttcgttgagcaatgcccattttgttgcattgatagtgattactgattagtgtttcgtttattatttatggtgttgttgtatgtgtagagtagtggtggtaattggcgaggatgaataatgctaaatttctgacacctcttgtatgaggagagattgataacctctcctttgagcacattatgcaatactctgagcctatcattatcattaggtttgttttgtgtttgtagatgagtgtggatatgaattgggttggatgctatgattgtaaaagtaattcctcgtactgaatgctcataaggcatgatagacttacattactacccatagaatatgagcatcacccttttcttctgatcaaattttcctttcattgtttattgtttgtttttggttcctttcaatagcattaaagaataagttgttcattctggttccttgattgtatcggtagttggcttactgctttttattgatcttcattttgaagattttgttgaggattatgaatattggatgaaaagtgtgtctcaagctaaagtaaacctctagtgattttccaaagtgctatggggaaattccgaacctgtaatggcaaacctgacacgcagtctaaaaactgtgtctcgagctgtctattgtgtataagctcctctactgtctgtggttgctttttgttatgttgggattggtggaaggatccatagagagacttcaatctgcctatgttgttgatgtttcgttaccattgtctaatcatctgttgtgcaccataagcagatgtttctgtgtatttttacgctttaaaattaatgttgaacttgcctagttcttcaagagctaccattatgtaaactgcccttaaagaactaggatatgtgtacaaattggtaactgcttgtgttttttgaatctttcaatagcaggaaagaaacaagctggattgtgttttatcattcacataagtttttctcagtttaagagtccatagagcatcgacatctgccactatgaagtataaacgttcctgtttcatataatggaacagctgggggtggctactaacaatatgagcctttcaaggtgtcattcccgttgatgaatgtaaagcattgttttaccagaaccatagacattttagccaatggtggtgaacaaaacacctttgttgaactatatccatccaatgtgtaagtaactctaaaatggtgcgattcaaatctacaaccaaaaccaacgttacattttcaataattaatcacttatctgtaagataccacgattaaccttaattaagccaccaatattcaaatctacatccaaaccgaatttgtgacaactagtcaactacagggtttacaatttaattaatcagcaaaaacggtgcggtgcctaatctaaatccaaaccaaacgttatatatatgtcccaataaagaaatgacacatactatatattgccacgtgtcatagtattcacgttcgactcgtcagagaccgacaaatgtcacaagctcttcactaaaaccgtaaaatgtacggttaagacaaaacacaacagaagaaaaattacacaagaaaaaaataaatgtaagaaaataagatcaatacagttgaaaataaactaaaaaaatgtgagataaaaatagaaaaaatgttaaaagaatcttattttgaaaaagtgaacttaaaaataaaaataaaaatttcggcaattgcttctcgtcgtttacttacacaagaggcaaagttgagtactactaagagcaagaacatactctttctctttctctctatctctgcaagtaagagatctttcagacaattttatttttgactttgtttaataatatatctggaattgatagttactgtttagtgcagcttctagatttccttatccaagattttgagtgcctttttcctctcttaattagattctagctacttctccttatctactacatttagtgatctggtgagtgattgttactgagatttgtggttaattagttgtggaatttttcaataaaaaaagtttgattgctagaagatattttcttgatcttatat

SEQ ID NO: 478 - DNA, 3000 bp, Arabidopsis thaliana
tatgcttaaaagttaaatctcttttgcagttctacaaaaacatctggattggaggatgtagtctggaatactgatgcagccgttgaagaacaaaagcaaaaaaaaaaaaaaatagcaagttgttcaattcaaagtttttaactaaagttgaatgtataatgaatagcaaaaaatgctggagttggcaaaatagaactattctttacaaaaagccaaacctagaagttgctacagatttagatccatatgttagccaatagccatatgcgatcatcctcaaaactcgggttggcttactttgagttagtcagacctatgagtcaaagttcaaacaattcaattagtcaaaaatactcgggaagttcgatatttgagtatagttgaatacaaagttgtcactttatggctacggttggcaaagcgttacagtgacacaatatcgacaacaatttggaaacacacaatgatagaataatagagagaagcaaaaaagttatgttagctataaatctacgaaccaagtatattctgagtataaagttttgttttgttataaatgggattggttaataatttgccaatcaagtagtgattttactacaaaatacataatgctggatatatagccaagaatatggatatagatggtccatgtctacgacaaaactagcaatgaaattgtggcggataaaaagacttgatcatttgtcgctattatgttgctatttgttaatccatagatttattcaaaacaaatgactacgatttggcaacagaaacaattgacagaatttatttatctggtgatatgatgatattgacattttcaatatcgaattcgtagttggattcggattaatcgtgaccaaatatttataattccatatattagcattaatctttcttattcgagattaagaaaaaattcgagtaattaaaaaaaaaaattgtttgaaaaaccattaaaatcaataatattgtattatatacagttatatactgaaattcaaatacaagaccacgacaaaatgtttactctaatgtttcaatttaatgaatcattcggtattttgaagcatgttagagcctggtagtactgtgcatgttatacagccaatatcaacctttttcgctagttttatgtaaggctatatcgtttatttatgtagcaaccatttaaattgttagtcctttttaaaattattgcaagatgtgagtgtgtacattcatacattgatgacggactggtttctagttagttggtattaagccgaccaacattaattgttggtttatgtctacacatgggtactagtctaccatttattatcatcattatttcatttatcttgcaaattaatactttgatctgtttattgattaattctctctattgttcattatgctgtacataaacctaaatatatgaattattagcatctgatgaactggatctttccaatattgaagtttgagagttggtatgcgtactgttgaaacatgtgtttcatgcagtaatcacgatattatggaaacgacgtcgctgccttttgtctttgttttctttttctctattatttcccagtaatcacgatattagaaatgatttaactattaaaagcattacattttaccaacaactttatcccaatgaaaacaaaacagggacaataagtccactttgggacctcaaatccgaacattttatttacctacaaagctacaagctacaactacccgtccgaggtctattttggacaccttggcacaatcaatatgaaataactagaaaaatactcgaaaactaactagatatgcaactccaaaactaattacttctttatcagatttataatatgaaataaattcattatgtaaagggtcccttatataacaaacgtcttaacgaagacagcaaatttataaatgacaatgactacaatactggaacagctaatagggatggtatataatggagaaacaaatcgaaatgtgctgctattaagaagtcatagtaattcattatcatcaatttaccatggcccatattaaggagtttgtatgcatgtgggatacacatttatacaaagaaataacaaatttgaatatttgggacacgctttcgtctacccttgttcttgcaatttggacagtgaacgcttctcatgaatgagaggtacgtttctcgaacacgttctccctttaaatttactatttacaacatattatatcaacttacccgtcgctgacccagtgcatttgcactacgtgcagccaacctgcttataatattcaattgatatataattttataacttgccctcactcaattttggataacctacatacacttgctaataaaaacatcatggatgtctaaaacgtttaagtttaattataaggaaatatataacaaacatgtcatattttgttgtgttgtagtggtataattaacaagttatgttgtttatcaaaaacttcaaaaaaaaaaaaaattaggttacaccaaaatagaatgttatgatgcccaaatatatgtgtgaaaaaaaagataaaccaaatttatgatctaccatatgacttatgagattcagctaggttttgttagacttttgtaacttgcatttcgtgtgaacaaaacatgaaaaataatctgactacttaatttaatatcaaggtcccatataagtagttgagctaatagtattatctcggaaccacccatcattaaattcgaatattattccatcttttttttttttttgttaagtcattactattattaatctttaaaatatttttatctttcttgcactctatatatctctccatccctacttgccctcatttcaccaaaatcctcctaattcaccaattttagaattcccattctcattttctctctctttctatttctccaaatttgcctaaagattttacattttatcttcaatccttccttgatttacgtttgaaatatttcgacccaaaactatactg

SEQ ID NO: 479 - DNA, 3000 bp, Arabidopsis thaliana
cgttgcgtttcataaaaattgtaaacagctttccaacagacttttttttcttaataggctttaaagcccaacgtcataactgtctttattaaacatgataaacggtagcataaaatctagacgaaaaatcaacattgttagacatgtaaatcatatgttaatagatttttgattattgggtacagaatttgtggttgttatagctacatgcatttatatatgtagtactattcaacttttcttgttgttacatgatttctatacgcttgattcgcattaatcacacttgttctattcatttgttccttgtttagctatcaccattcgatctcgtatatgtacccaacccaagtactgagtaactatttttataaatttatccaagtacgagtgaatcaagtatttatttttttagaccaacttttattctctacatatacttgaatcttgggatacgtataatataaaccaaccctctttagattttaggattgtatttttgtgcatacacagaaatctgagcatagacaaatggatagaaaccacatttgctttatttctatagagtttggacattttttggctatgattttgtaaaattgttgtgtgctccgtgttagcgtttgccgaatgtgacactaattttgatcgaacaaacaaaaaactgaacataaattaattaatttgcacacatgtttaacatctataaaaaaattaaaaaaaattgcacacataaatatagacaaatgtttggaataagtaaaacatgaatccaagtgttattaaaatcagtattttgttactacaattgcaccaacaaaattgtatgttcaaaaatttagcgcagtacgaatcattaataacttgtccctaactactaactatattcagatgtatgcctaacttgtaaatgttactcatggttgagtagttgaatgttgaagagcttacgttataattaaatgctcgctttgattgatgcaaacaatttcttcactataataagcgaaaataatagaaataataaagatggaaaactaacaattaatagtagaactatatatatatatatccacatataaattctttttttttttgaggggtggtttaaaactagctatttagctggatgctcggctattcggatttgtgtaaaatacttctaaatattgagcaataggtaaatatagtgaatatttaaccatgacaaacaataaaacacacacacatcagaggaaacttgggaatgaacgtgaacaataaaaaaaaaattaataatgataataatagtgggcatagagatggttcttcaacgaattatttcttgcccaagtagcaccgtttggttagaaattcttcgacatttatagttcaattaaaaattactactccataattttgggtgacttaccacacaatctttccacaaatcttcgacacgcaattcacaacagtatcatagtttattatcacactttagtaatttatgccaaacctcactacgcaagcaaactatgattcattagatgtgtggacaattacgacgacagcaaaaaaataatatgtgtggacacacaatgacaaactcacattgaactatcttgaaataaatttatactaaatcgtagcgaatatataatcagtaaatagaagttaaactgaagatcataatcaactaaaatgaatatcgtaatcaaattgatgataataatgatttcagacacaataatggtgacggtgttgatgatgaaaaggatctgtggcataacaactgattgaattcaatgcatcttcatgggttttattccgttagctttatctttcacgtctttatattctttaaactttgttatgttattgacatttaaattcatttgtatgcatgttatgaagagatcgtataactacaaaaatataaaggtaaatctttcattttaaaaagaaaatgtttctatacgtgtaaataattagtaaataacacatatttcctcctgcgcgtagcagttcaacaaactctcttcttcgcgtagctagaagctgcaataacataaagaaatgatatatttataaattatgtgaaaatgaaaaaaaatattagtccgcaatatccacgtatcattatgcgccacgtaaacaaagtggacccagaataacccttgtttccagtagaaggaatcaatcagtggcaagaaagaaaataatgaatttcattaaatcgccactctcgagccatcaaagtatcaaacaattgattggagttagttgtatccttcgcctacaaatttttccttactctgttttataagtatataatagttccactaaaatcattttggatacaacctcaatagatctcagcgtattgtttcctgtatgttcaatgaatccatcctccatgcaatctggagactggagtataaaataacacgtatggtatggtatttatttctcatagctagttccttaacagttggaagaatttatacatgacccggccctttaaaacctatccctactacaagacatttgggttactttccatcgacttttgaatgtgcatcaggcatgaaaatcctttaattatgcatattttataatcaatgcttaaattactataaacacaaaaattgtagtgatatattagaaagataatttaaattgttacattgaaaagataataaaaaattataaatagacatctgatataaaaatggatgaagtatagcatattaaaaaaacatatgtttttggtcaaaacagaatcaatgcatagttagctcaccgctacaacaataaccatagggactacgtaccatccataactacattttcttaaattgcatcctctttctaaaattttgcctataaattcacaataacacttcaactttttaggccataagttatctctttctctacaataagcaataaatctcacctcccttttttttttttttgtctcgctacttttgattatcatttaaaaccaaaaaacctacc

SEQ ID NO: 480 - DNA, 3000 bp, Arabidopsis thaliana
agaaacacccggtcgggtcatgcaatattgtcagatttacccctgaagatctaaataattacataaccgacctatatgttggtttaggaagatccgtgcccgtatccaaaactaagaagtatatggttagcccaagccatacgacggatttgaagtaatagctccatgtaaaaagccctcatacgtgtaactctgtgaaatcaacgaatcataggccggtcctaggctaaaagcccatatatcaattttgggcttcaaattatagaccatagatataaaagtctacatttcatttgccatattcagaatcagtgtgtacttgtgcttgcttttgttctctattgatctgatcttcttgtacgtgtgttgttcacactcacgcctaaatcacattcttctttataaatctttttgtttaaccttttcttcgcaaacccataacgtgtagggtttagtttccttgtagtttttagtttattttaggattcagtttggttcggatttatgcgtttttgtgactaatagttttaaattttgtttggcaatcgaatggagaaacagtcatgcacaatagtaaagcaaatgacttgttttatatttttcgttactttgataatgttattatggttagctatggcctatgcatgcaggcggatttgaattgagtatatatttgttgaaacaaacatatttttacaaaaatgaaagaaaaaaagtactccattgacttttttgtaaaattaaatagataaatcatatgatagatgaccgacaaaataatatggctcgttgctaaaaaaggccatgattcgtcgcaggaaaataaaaagaattgtggttggaagttaagtagttagatgagcaagtctttaatgatgatggatttattttagtattctgtatgcaaacgtaggagacgtataccagttttcccacgatgtatctgccatttccttaaatttttcagtggcaacatgcaatgttaacttcaaattctattgaaaaaaaaggttaacatctcaacatactacttctttttgtccatattttgcctgcataaaaaatattaccatcacatatctctctgtcttgcaacaaattaaccaatatacatttggccaacgatctagggtttgaaagaaatgtttttaacacacggacacgtaacttgaatgccgtttatcattataaagaaaacaaacaatatacaaggacacttaatcactaagccacaatgaaagagacatttgattaataatgcattcacacgtaaatgattgtgaaccagtgtcatctctccatttgctaccaatcgaatcgaaaattttggtttatttggataatcttaagaaaagtcaaacttataaaatgaaatgaccagctaactaaaaacaccggcaaacattaactcctgtaattatcaacttagaaagaaaaaaacattaactcctccattattagaactaacctcaaaacaacaactcttaatgctttcacaaagtgtttccaatcttctcgaccatttttataaagcaaattgacacgcagtaaacgcgtgatcgtcattgacaacatataatgcgtccaaataaatttaaatgatgtataaaaaatcatagtctttgtagaattaaaagagatggttatgaatttgaatcgatcaattaaataagagaaaaaagtaaaggacgtagtcgcacgcggatagtgtgagtaagcgttacgttgatggctttgtagtaaaagagagatacgtaattaagttggtggaggttgagatgagagctttcatcacaacactctcacttatatccaaaaaagttcattatttcataaacctgtatattgcttcttcatactagctcactttctcaccaaatctctttattgctctttcacctacaacctcaaattttctatatagcatataataaaacatattaattaattttgatacccaatatatctaaactttaaaacttaatttggtccaacaaacgtcaatcgatacaatcatgtgttcttctagcttatggattctatttgacgacatcatgaagagtttgtacaaatcaattaatttggatattacataaactaaaaatatgttgtttttttttacggatgatcttttaataactgaagatgaaaattaattttagttagaaatgtcttgaataataattaatgtcacagaaaagtcagaacgtaccaaagatttccgcgtgtattaaacttaataaatagacacaagccaagtcttagcagtgtactactactaacacacatccacatcaatgtgtcatctttgttgtatgacacaagttagtatgacaatcagtgtttgagtagtgatggtttaaatggaatgtttgagaatccaatacaattggcggtctgctaatggccagaatatctgccaaagttattttttatctactgcttataaatcgtacaacaatctatttagttctctttagttttgaccttgaagtccatgaatcttaaggacctcttctccacatcattcaaattcacatatcggaaacacagtactgcttgaatgcccctcccatacaatatgtctatccactgatccacaataactcgatggtgcatgtgtgtgtgtgtgtgtgtgtgtgtgtgtgaacttcctggctgtaataaatttaataaatacttaaatagacaggcgaagtcctcgtccacttttctacacctagcatcaatcatcaatgtgccatcttattgtttcaatttttcttaccataactttgtccttgcatgtaacttttccaattaaatacaagtctgtcttttattaacccccgagaatttactaaatgatattgacataatctattggacggaatgagttgtcaaaaaacgagagctgtcttttcctgctccactgtcctcttatatatcccacaacaatctttgctacattttcatgcatttttaatcactcctctttctaactccaataaaaacacaata

SEQ ID NO: 481 - DNA, 3000 bp, Arabidopsis thaliana
cgaatcgaagatcgcgtcatcaccataaccaaatcctttgattcacattccattccatagttttattcatggattttttcgcgattgaagcaacttgatcgatgattaatatttcgtccctctctctctctctctctctctctctctctctgtagaaaatggaatttttgatatatctctctgtagaaaatggaggaacgagagaagaaaaacgccttggcctttttctctctctaaaaggacaaaagtggaattataacttttttcttttttttttccttcgagaccaaaacgaaggaacaaatccgtataagttaatatgtctaatactataatgtttttgtcctgattccaaagtatccttagcgttacagtcggtgacattatttatttgaccactacatatcggtggacagtgacatatgttttcgcctatcattggtcagttgtggaggtgctgcgctttccactgttgtgttgtgtgatgggggaaaatgtataattatcattagtaagtactaaataattatttttgccaaattatcctaaatagaattccattgcacatttgttttttctaatctgatattatcatatcttacttgagaaaaattacaagtttctttcaggggtcaaaattaactcatgagaatacccaagcggtagaaaaaaagaaaaacgattgaaaccagtacaaatcaaatgaatttaaaaagtattactatagtttataccaaatgtatttggatggtgaataatcaaaactgaaacgaataagtcaaaggagtgttttttttttataactactaaccactcagactcagtgacggattaaaagattaaaacttaaaccggatataaccgaataatagaaccagtcagtgcaattcgatttaggacataatgttaggaagcctcctcgtttaaaagttaaaacctctctttctgcggaagaaacacgcttgagatatctttccccaaattcgaaagaaccctaattttttccgattccgattgatcaaacaagcgaatcccgattaactgatcgaggagatgggtaatacagataagctgatgaaccagatctttgaattgaaatttacgtcaaagtctctgcagaggcaagctaggaagtgcgaaaaagaggagagatcggagaagctcaaggtaaagaaagccattgagaaaggtaacatggatggtgctcggatctatgccgagaacgccattcgcaaacgcagcgagcagatgaactaccttcgtctctcttctcgattggacgctgttgttgctcgactcgatacccaggctaagatggctaccatcaccaaatcgatgaccaacattgtcaaatccctcgaatcgtctcttaccactggtatttcacattctcacttttcagcaatctaatcaatttggttttgttggtgctcatagcattatagtatagattgaaaaattctgctccttgttgttgtttttgctgattgaaggatatggaatcatgcattagggtttggtttgatgaaatattagaatagctctctctcaccgtcatggatgttctgtgatctgtgatgaatttttgttgcatttctctccttttggtaagtgtagtatagagggagaagaagatagggcttataatactcttatacgttgtgctgtagcaactcgtgttatcattttctggtttgttctttgcaacaggcaacttacagaagatgtctgagacgatggattcgtttgagaaacagtttgtgaacatggaagtccaagctgagttcatggataatgcaatggctggctctacttcattgtcgactccagaaggagaagtcaacagcttgatgcagcaagtagcagatgattacggtcttgaagtttctgttggactacctcagcctgctggtcatgccattcctaccaagactgaagagaaagttgaggaggatgatttaaccaggagacttgccgagcttaaagccagaggttaattagctaacctaacaaaaaaaaaaactgtatttggattcttcttttattgagatgttgatgctattaatccctgaacatgatgggaatgtttgtgtaaattgctcaccctggtacatgcttttgtttatataaaacctagagtgtgtttttacaatgagaaatttcatcatctgcttaatggtttggattagttgtacaaatgttaattctccagatgtgtctctggtagtagttccaccaaattttccaggtccagaaaggaatacactggagtaaaaggtatattctttccaaggagaagaatgtttatagtactcttggtggattgttgcagttgtcaacttgggagagaggatgatatggtgaagtctcctccctctctcccatgtcttgttcattgcaaagtcttgttctttcatgtttcttttcatatacacttgttaatgaataaagttgaaaaaattcgtgaggaaaagtccgaatctatcttctctgcaaaaataaaattaagtaaaagaaacataaagttatggtttaaagatgctttcggaaactccatcattttagtgggagaatcacataaaagattggtcgtcaattatttttcttttattaataaggatgcacatgatgatgaatattaaccgtaatatactaatatagatgacaatgtatttcagtgctaaattatagtaacaattaattgaatgcttaaatgaatcttttattatatactactttatatgtgttttttttgttttaattgagacaatgatgatgcacctagacaagaacgtcctactctctgtgcatgtgcttctcattttatttactcttttaccaaacaaactgttcaacttaatacataatgttggtagcccacaatgtgaaagattaaattaaaactcatccattacctcctgtaagctctatattaaccactttagctcttctgcacacactcacaacaaccaatcatatttattattaaaaaaaagagtc

SEQ ID NO: 482 - DNA, 3000 bp, Arabidopsis thaliana
cgtaattattcttttaattaattgagttttattttctttaatatgattaattaattaagtggatatgaatgcaggtgagataattttgtataaatattagccaaccatttttaactgatcgttagaaagaaaccaatgtggtttttacgaaataattttcactaattagagagattattcaactatttagagaatgtaatctgccttttattagtagtatccgaaatttctaagaataagaaaggcttacctgatttatattctagttaaagaacaaagaaatttgttggaacaatcttgttgatttctggctgtttaacccaatgcttttctatccattttgtttatttttttattctgattcataagtttacaaagatattgtttagcttaccaaatccataatacatgttgggatcccaaactacaatgataataacgaaatagaaaaatatatacacataatggagattgattcgaaaactaagtaaagcttccattatattactgaaggtgtaaatggttgccgcggttaaatctgtttgcagatattattattttttatttacaatttataaattaaaatttattataatatgaactaagaaaaataaatgaaatttctcgcagaccgatcataaaccgattttacattaaataaagttggtttacattgtatgtcctaaaaataaaatgaactaaaccgctgacggatttatctgtatctaccgctgcaacctacactctttataaacaaatttattatttttgacacatcttataatctaattgattatttaaaatattatcttttaaattctctaaatcgcactatattaaaatataaaaattattttgttggagaaacaaaccttaaaaaagatatataaaattatttgttcaaaaaaaatgttaaatagaaattaaagaaagaaaaagagaaaaaaaaaacaaattgagaagaaaagaagaaaagcagcgtcgtagagacgcgaagttaaacaacaggtcagagaataaatagaaaaaccaaaaccctttagcgtctcccaaatcctctcaatcctctgctgctcaatctctcatcatcggcatcgctctctctaaaaatgtctcagatggatcccgacgctgtatctaaggccttcgtcgaacattactattccaccttcgacaccaaccgtgtcggtctcgctggtctctatcaggaagcttctatgctcaccttcgaaggtcaaaagatccaaggagtccagagcatcgtcgctaagctcacctctcttcctttccagcagtgcaagcatcacatctccaccgttgattgtcagccttctggtcctgcttccggtatgctcgttttcgtctccggtaatctccagctcgccggagaagaacacgctctcaagttcagccaggtatctctctctctttctcttcgatttccgattgatctatctttgtttggatttgtttgatttgcttgtgagtttagttattagatcgctagggttttagattagctgatggatctgtaaatctgactctttaaaggatgtagaattgcaaattcgttgcgacttgttatctgattcgttttgagctacaatgatcgatgatgttgtgactcgtgtatagctcattgatgaaaaactttgcattagtctctgtttagtctcgaagaacaagtttggctctgagttttgttgattagattgaagagaattgttttccctcgccacaattgatggatttcttgtccatgaatgagattgaataagctggttatgtcgatgttatgtattgtttgctttgttatctctgatcttttttttgttttttttggtatctttgatcttgttctaacacaactacaaaacgtttggtttcattgtgtgctacagatgtttcatttgatgccgacgccacaaggaagcttttacgtgttcaacgatatattcaggttgaactatgcctgaacagaaatcagattgttgttagcatacatcattgttgcatttctatactatttgagcaaatccttctatcaatttttctcgtctttttcttgttattcccagatgatttaccttgggaacagaggaatattgtctctcatcatgtatttggtttggattgtttgttcatttgtcattacaatctattgactttataagacaatttgaatggtcatttggctcttgttctttctgggaatatgcttttaatccgaatatatttggatggtccaagcttggcctgttaatgtgtctaaaggttaactcttatctattgcaagacttgcaagtagtttcaatgaacacctctctatgtataaataaagccataagttctaatttagttcagttgcaacatttgaccgactaatagtgaattgaaaaatgaagtgtatctgggtcatattctgagttttgtcgatttgtttgtggggttgcagttggagattgcttcaagttttcaataatttatttacttgataagcattgcaagtgtcaagcacaaaagttgcagattcccacaaaccaaataagaaagatcaattttgatgtagaattttgcttctttttcagaagaaaagtctcagcttcactgattcgaccgttgattcaatttctatggcagttcataattttcagaacgttattacaatcttaagcttttagttaatacttaacactacgttgatctgctttgattttgatataagttttggttccaattagatttcgtgtagttttcttcacccacccactactatcagactatcagaatctgaaagtaacccactttaaaaattgacaacacacgcaacgaaacacaaagcgccaaaaattaaggaaaaaaaggtttgtcgtaatctgatactattcacgcgatgacctcgtttttgatcatcttttccttttctatattcttttctcctctgtcccaaacgattcacttttctcaccatctcaatctccagaccaaaagaaacaaaaa

SEQ ID NO: 483 - DNA, 3000 bp, Arabidopsis thaliana
cgtgttacatgtttcaatcgaattctggttatcagccactttggctcaagaactctctttgtaaagatttactcatataaataaattctgtttgttggaaaaaacaaaaaaaattgttaaagttaatacacttgcaattcaaaaataaagtggcagtaactaaaatgactcatcttctttacatattaagttatctcccatcttattcccaacttaggatttagtactaaattgtttcccccgaatcatttgccgaactcaaagaatcctatatagtctagccaaaaatattgagaaacaatgtaatgcaatcttcaaaaagcttatgatcagtattcagtagattaaagattcatatgattgcaatatcaaaatcatatgatttatacataggtaatgtagctaagttaggaggaggacgggcattggtgatttatttttaatagaaaggagagtgatgagaaattaattatgtcctaatgattgtaaaagatgggtgcaccaattatttgcgaatgctgcgagaacgtggaaatgaacagggtgaggataaggatgtttctatttctgtattatttatttttatgaaaagtaaaataaaataaacgtgtaagaaagctggccttgggcctctttgatgggtaggctttattcttcaacatcaccatcctcactcctacggtttccttgtgcataggggattcatttttttttactcatttctaaaaccatgaaaaaaataaagtggtgcagatttatttggtggtctttagacaagagatccaatcattttcctccatagatctctactataaggttttttttaccggtgattattagttaggcgttcaaattggcaaaatgtttttcagtgtttacaaaacttgaagaataatttaggtttccatttaaaattcttccaattatccaaacaaaccaaaaagataaagagtacagaaagtattcacaagatcttgattcacaaaatctcaagatcttaattagctttttgacccaaaaatataatctttttatagggtcattgtgatcctaagtatatgataattctttacatacatatgtgcataggggccgcgtgggttacttgaaccaacaaattagctctcttgtatttgtataaaccaagcaatttttaaattctaaaattatattttgaaaagtgaaagaagatacactttttaccaaccgaacaagtctaactgaaccaaaccaaaacttgaagatgcgtatcctacatttgaatattatataagagaaattggtggaaaattatacgaaatttaaatttattgtaagtactattattatttggtaatcggaagttctgatccataggcatcatgtaaatactacaatagttaaatacgaccacatcaaaaccaaatcctaggaaacacatgaggttatgattttaaccaccatactcttactggtaataattcaccaccgagaaaccggagagaacctacaaccagaaagcacctacatcgaattttggaagcaataaagattacattatgtatcagaaataatcgttaatacatgtaacaatgaattatttgtttcgagtgcaaggtttatttatcatgattcacagtatatctaaaataataatttttttgtttagatatattaagagctccctctggcagtttgatttaaacctagaatttgtaatttgtatacttctgatttcaaattcatccctaaaacggtaaaaatatatatttcaacccgaatgttcaaaataaaattatatatgtatatatattcccaaccctacatgcacttagatattattgaacaaataaattaaatagagtaaacaaaagttaattactgcgcgtcggagagaagccttggcgtccaagtcttaccaccgaaaatatgtcgacttcccatttgctttaacttaatttgataatattataaatatactaacattttactgactcgaatacaataatagtgattccagtaaattattaactaataaagaatggcaatgcttttttttttttaagaatgacaatatttcataagattggcaagatgcaattgttttttctatcgtgtgaatctgagaatctcactcaccgcccaatctataaccctgttcaagtttaactatttctagtagcacgttagaaaagagctaaatatagaagactttatcgatgggttttatcttcaacaatatctacgtaggaatatatttcctgtaaaagcatttagtcacgttccttattattaatatctttttaatttcagtgacctaaatattagattgtgggcttgacaatatccctaatactaaatagtagtgttttctctacatatattttgtattttcattttaacgaaaaaagaaatttcatcaaaagactatagctttttcttacataaagcataactttatcttgtacattataatcgtgaaattgttgaaacatttcgagtcaagaattaattaagtaaaactacgacccgtgattcttttcttcctttgtcgacaatccatacgcgtgaatacgtgattagtcaaatgtaaaatgcaaaaagaaaaaacataaaacaggaccataccaataccatattctcactataccaacttcgatttcataaacccaaataagaaaataaaaacaaaaactccacgctgtatttccatgtgtgcgagatacaagaatagactcgacatgcaaaataaaaataaatatgaccaaataatcatataatatcttagaataaataaattaaaaaatcatagtaaccattttataaatttcgtaaccttttctccgtcatcccccacataccactccctataaatgccaagcaaaatagctttcctcgatagttcctaaatcataactacaaaaacttttccttcttcttcctcaacctttgcttcaatcttcaacaactttctttttataaagattttgcaagttaagtgtaaacctacaaaaaccaaac

SEQ ID NO: 484 - DNA, 3000 bp, Arabidopsis thaliana
atcaatttatgtaaatgtgatgaaagcacaaggcatatacaaaggttagttctcactgattcttgattgtagtcatcaagggccttcctagagagcctctcgagtaaatctcttgtggtttctggctcatcaacgaattcatgtgaatcgagataagcaagatggtaattgaatacacaacggaagtgtgtgaagtcgatatcaaaaccctgttgtttcacaaactctcaatttcacaaatttatttatagagctcattataaaccgaaaaaaaatcacaaggataaatacatcgcttgcaaggatttgtttgtcgagtaaggcaagttctttctctggtgagtacttaggctcatcttcctctttggtccaatccctatacgctggtctctcatagccaggatcctcaggtttccacagcaaaaacactggttcgagccatttgatccagcctgagacatatcattggaattgatcgggagagagtatatataataaaccctaacttttagggaaacgaatttcgaatcttaccttcaaattcactcatcgccttgtgcgtacgttgatgtcttgatgaacagaagatgagccctaacttcgggaactctataatgtcccttttattttactcaagtcccttttatttattgatctgtcttcctttgccctcgtattgtttgttttgtaagactaccccctcaaaaaaaaccggtactaaataagagctagtttttttttatgatgatgagtcaatccaacaattttcttaagtttttctatttgttattaatattattttactattctttttgccacacaattttaattccatatactactctttcttaaaaactaaacttatccaaattaaatatctcaaaattttaaataagaaagcttttataagaatattttagttatattaaatgtattatgtttttctattagaaaaaaaaatgaaacaataaaaatatgtagtatatgtatttcaacactaacaaatgacttcatataatattaagttttacattgaaaccacaaatcaataagcctaaacttagaatgacgtaaatgcaactttattttataatataaattaataagatatttaaaatttaatttaaaagtttatttatagacaaaaaaatggattttgggttttttatttatcttaaaattaattttaaaaacaatattaattagaaatcttcataattttgattggctacaaaacatattttttgtaaacactaaaactgctttaagaactacaaccattcaatgccaaaataaccaactgacgtggaagattctcatagcaactccattgcacaaataagttgagtgtcttcctacacttaaaatcttttatatttaattattaatattttataaatttaatattttaatattgttaaagacatcttctttctattgtgcaatgaagttgctctcaggaccttaagttaacgtctccgattccaccatctcaaaatggatattgtggtaatactctagtagaagcctctatttcgtcctatacggctatatctgtagctataagatagcaacattggacgaattcgggtccttaattaacttcaacattcattttgagacggcgatggtggaatcttctcataagctatatcatttcagacatttctaagcttggtttaattattaccttttcacaatgcttactttcactctttttcttagccaacaaataaactatcttgtcttttcctgtaaaatatgttttcacttttttttacttgccagttttcaataacgatgatatttgtttgtctatattattgaagttaattttttaatttttttttaagagatgtagtactttttgaaaactcgcatttgtttacatatacaagttattgtaatggtatagtgagtattataatgggtctttcgatcttggtcattctgtttatgaagcttttcacaatcttaaaaagggaaattcggattgagctagacgaattgacgtggaggagaagtcgaaagcttctgaaatgataaaaagggtttgaataatggtgattaataaattataagtagagaaagagaagaaaaaaaaactaagcctttttacacgcctgtgacttgggttataagcaatcaacatttcgtttatctcaagccaatgggaatatcattattgctacatccgtccaatttgtggtttggtctttgttgcttgacctcctactcgatcgtctttaaataaatgagcaataaaagcttttatctcctaaaaaagtttgtcattttatttccacatatcaagttatgtttcctgtacatctggacacatttacaaaaacaccaaaaaaactataatattaaaaaaaattaaaaatgtatatataatattttctaaatgatcaaattttaaaaaataccaaaaaaatccattaaatccttgttgactattattgtaactttacaaatgacaactcaacacctcataatatttggttttagactctttaaatccttgttgtcaaaaaaaactatctaaatccttaattatctattaaaaaattaggaaactaaatcgaattacacactaagaaaaaacaataaacaaactttaaatatcccacttttccctctaatccttgtggatttggtcataactcgttatccataaacccaaaaatagcaaatgagtcatctctcttttgttccaacaagatcttttttatttggtcaaaaaggtgtataaagtttgttataacaagttagttatataaaccctcacgaattcaagaaaccaatcaaaagcaaaaaagctttctctttctctacctttttccttaatttcacttttgcggcgtcgttcttatctactcacaagaaagcaaccgatcaaataactcccagaataaagaaagactcaaactttattctctctctctttcttaaatagtgaagaaagcttcgattttgggaagtgggtttgttcgaaaa

SEQ ID NO: 485 - DNA, 3000 bp, Arabidopsis thaliana
gctgtagagatagtacacatacggaccctgcaaccagtccccagctaaatgccgccagggacataaattcattgttggattttaggatctatggacaatcaatcaatcattgggagcattcattcattcattccggtcaaatcacacaccgacactaagctctatagaaatcagaaaatggatcgtgatcagatgtagtgagaactaacccatcatgagagagtagacgaggagatagttgttcttgaaggagttgaaggcggaggaggtgttaatgcggtctttgttcgatttgctcagctccaagccggcgacgatcgcagccaggccaccgaacaccacgaagtagaagatctccattgatacgatcagatctcgcaagggaggaaggagatgatgagatttgtaatttcagatttgtagagtgtgtgtgcaagtattaagtatatatcgttgatttaaatgcggactaaataataataagtttatgtgcctttgcctctctctaattcatttctttttttcatttattaacctcctaaccttccaacaatgtttttttttttttttttttttttcaaaactaaaatttacccaaatgggcttacaaacggactagatttgtgattttaatgatgcagccgaaacacataacgttgtattttgggtcttgtttccatggttcccctttgggctttatgctccgttgttggttttttggtattttctgtttggccctgaggcatgtgttgtattttctgtttgggccttgtaatatgtctttttaatggaaaattatgaattaaaaaaaaaaaactgtagtttcattatcatgttttttttataaatatctcatggaacacctaaaatagaaaataattctcataatcataaggactaaggagagataagcaaacctaacattcttatttcctaagaatacaaccgagcgtttaacgtaccaaaaattgtatagagatgcgtctagattttttagtaagtgaaacagaattcacaaccatagagaaatgttgttacaatcttgtatttgtttgactatatatatgaatgaaagttacgcaaataactgaataaaaaaaggagtaggaaaataagaaaaaaaagaaaaaaaaaaagataagaaagcgtagaaattaggatgaaatgtaatgcttattacttatcttcatgtgaagtttctcaaatatctatatatacatttttgcatctattttgtaaaataaatcttagagttggaacttatttacaatggttgtaactggcttttaattattgattttcttttggcaataaattgattaacaaacaaaaaatattccaaatatattccaatctcatatatcatgcagatttctccaaaatttgaactagatttcggaaattatttaaaacaaaaaatatttgacaaaccaaaatacaattgcaatcccttaaaatgagcaaaacgcacctaaatacatttcttatcagttcactaaatcttatttctccaatatttgaattagatttcgacaactatttaatacgagacggtatagcacgggtgaaatccattagatatgtttagtttcactgaacgggattagatggtaggacgggtttgagtcgatagtaatacgaaacggtataccacgtgtgaagttctagatataacaatcaaaatataattatattatcttaaatactaaacaaaacaattataaaataaaaatataattaaattttaaattatttagttataatctagattttaatttaatgaactgaacgttattgttcttatattttaaacagtaaaagttaaacatagtaattgtatactaaataatatatagatataagagttgtacattcagaaaatacaaaatattaaatcatatatatttttaatcgactaaacaaattatacttttatttttaaaagaacaaaatagtcccgcaggttaaaacctagtattttacaaaaatatagacaaataaaataaaaatgaactatcgtggatttagttagagaaatccatacaaaaataaattgcattgagaaactttagatgacgactaagtaatataagattttgcattgagaaagcttacatgtcaccctaatttctatcaaaagggtttctgatactaattggaaccatgtgagaaactatccatagaaatgatgatcttatctagttatcatgagctgatgactttgaatattccacagtcactaaacgcatgtttatttctcagctttatgaatctgtatgtagacacactttcgtattttcttcacttttgtgtatttgtattgcccattcctcttttaccaaccaataaaaaaagcagtcttttttttgtttggtcaagcattggcactctttgtcaatcaattacccaagggatatataataataaattggaataatgaaagtagttcatcataaggttcgtgattattaacttctacttttgtttatattcaatagattaagatgccgtgtatgataaggagagcaaaagtaatccgatagagatcacagcaatattcattacaaaatagttttcaaataaaaacacatgatcaaaaagtgactcacaaaaacacatgatacgtacgtgggatgctaatcctaaagcaacaaggccacaagggcaaaatatgtagctttcatgctttggcaaagcgaaaactctagttaagcttacctaacagaaaaaataacccccaaaaaagcgttacgttccaaacatttagacagggtacacgtgaatgactcccactttttttaaaaaaataatagtactatcaattcaaatgtgtaaacaacaaaaaaaaaaaatgtgtaagtaacgtctgtaattgatttgataagataaaaaaatcttgattaatttttctataaattgaagcctttcctctttacatttcgttaacacctaggttcttgtttcctaacaaaggctctactttttctttagttaactact

SEQ ID NO: 486 - DNA, 3000 bp, Arabidopsis thaliana
acttgagatatctccgattctcaaattgcggaggacccagaactgacgcagctcacgtagggtttttcttttagggcagagaagacgaatccgagatcagaattttggatccggtacccgccgattcatgctttttaatcttcttaaccaattacgtacagacacgagttagtatgtctggttttgggttccacgtggatctgtttggtttgcggcagctattttattcccacgtgcgattactgatcaaatctcaagccaagcgttcccttttgtcgtcttgttctgatttaatattaaaccggaaatgaccgatcattcagccgctagtgtttggtttgtatattttgacgcattaatgggcttataattgggcttcttttttagactcgtgttgtcgctagcccaatggataatctttgacagtatcgttcaaccacagattatcttcttcgcacgatgtgataaatacaaaattttcaaatcaagaagaaacttcaagatacaaaattattgcaatcagtagatttggcgtggatgatgcatctgtcatcgcaatcttgtcttcttcttcattgacaagttccatgtgtattgtgtagctccaggtgttgttctctaatcggctttatctctatccaaccatcttcacgactgtggtctaattgatttgttagtgttcttctatttcctggttcagattcttcactgctgtgtatagttcttctcattcaattacttgggttgtggtttaaatcaccaatttggtcatcttcttgtgtttttttctatcgttgacttcgagctttacatagtgagatcgagatgtcaggtttctccagtggaaatgttaattctagggttgtggatatactcagtggtgttgtgcctttgttgaagcttatctgtttaaccgtgattggtctacttcttgctcatcccaagactcaattagtcccaagagccacgtttaggctcttaagcaagcttgtgtttgctttgttcttaccttgtttgattttcactgagcttggagaaagcattactcttgataacattgttcaatggtggtttataccggtcaacgtgttactcagtgcggtcgttgggtccttgataggatacttggtagtcctcatatgcagaccacctcctgagtttaatagattcaccattgttatgactgcttttggaaatactgggaatcttttgttagctattgttagctcggtgtgtcacacgaagacgaacccttttggaccgaattgtaactcgagaggggtttcgtatgtatcgtttgcgcaatgggttgctgtgattcttgtttatactgttgtgtatcatatgatggagccgcctttggagtactatgaggtcgttgaggaagaaggggttgagatagaggagatcaatgtggagaatcatgatgctagtaggcctcttctagtggaagctgagtggccagggattgaggacaaagagacagaacattgcaagacaccttttattgctagagtcttcaacagcatatctagtttctctcagacttcttttcctgaagttgatctcgggggagaatatggaggagagagttccagccctaggtctattcaatgcttggctgagcctagagtaatgaggagaataagagttgtggctgaacagactccagtcaaacacatacttcaacctccaacaatcgcatctctattagcgatcattatcggatcagtgcctcagctgaaaagtgttgtctttgggtatgatgctccgctttctttcatcacagatagtttgaatataatgggaagtgcaatggttccctctgtgatgcttgtacttggtggtatgctctctgaaggaccaaatgaatcaactcttgggttacgtactacgattggaataagtgttgcaagactcttggtgcttccgttagtgggaatagggattgtgatgtcagctgataaacttggtctcatttcctcagcagatccaatgttcaagtttgtgcttcttttgcagtattcgactccgagtgccattttacttggagccatcgcgagtctaagaggttacgctgttagagaagcctcggcacttctattctggcaacacatctttgcactgttgtctcttacgttctacattgtcatcttcttcaaactcaccgttgagactactgtccaaggtatgcaataaatctaaagttaaatgtcaactttgtttgtaaagaatgtgatgttatcaaatacattgaacttcaatggtgtgtgttggtgagtgttggtggagtattaccaattcaaagtttaagaagttttgtaccaaaagtggcatgaaccgtgcacttgcttgatcttatttcgtggcctaaatcatcttttaaatagagcatcatcgtattcacatggttttagatgagatatgtatacacgtaacgtaacagtgacctttgttatagaattttaaacaaaagaaatcaaagatatggaccgtcataatatccaatggtggagaaaggctgctttagagagatgcgattggaatatgcgtggaacttacagaaaaacgtgttaatttcttggaatgtgaatcttttaattatagtttcagagaaaagataaatcattttggcttcgttgaagaatcaagatccgattttatggaaatgagtgaatggaagtaagtttttgctagatagtaaaaatcatgcctctcttctcaccatttagtcatatccaagtggcatggcctctgattatgttgggctcctgattggtaaaatatttaatgtattaaattcatatttcaatacttaaagataatcttttcaaaattcagaaatttccgtatctataaaatttagcctaacctttttaaaatggtctttacttctctaaaaagaaccgtcaaatacgaatacgattctaagttttttagtctttatagtcagtctctcacagattttgtgcattcaaatcacaaagcaagtcgcgtaca

SEQ ID NO: 487 - DNA, 3000 bp, Arabidopsis thaliana
accgtgatctatactcttatgaaaagtgagtttcagtttaaagctttgtcgagttttatctcttcttttgctatgatattttaagctcaatctttctatttatgccgaattataggatcatggagacagcaccaacgcttcctgattttgccttggcattgaaacccgatgagtaccaacttccttctgttgatgcgtcatggtctgaagccagtctacggactaaaaacacatcaaatcacatatagggcaaccaaagatagagcagtgaatagaatgcatatcaacaccttatagagttacaatgccaatggccgccatagaaacacaaatggtatagctctataactaccctagtgattctccaaatgtcaaataatatatgggtgtgaaaaaagtaccgaattggattagttttcaggtaaaaatatgggaagatgtcgtctgttttctctgtatgttgttgtaattttgtatgtttagtgcaataaaattcgattctttctgttccacattcattactattacttagacaacaacatctacaccaaacaatagcaaactggtaagtttctgctttttgctttgtttgacctactaatactacaaggtttggtctacagaagttacaaaattacagaataggtagaagtttgaactttaacacgactaatcgccagtgagagctcgagggctatggtcaatagtggaaagagacatgcccgactgagccacggctctgacaaacgccatgtttgcagtcaaggtaggagctccccatctatcacctgtcccaaacacagtcttgttcttcatcgctaacttcctcgttgttgggagactcatcacacgctctgagggattgtcatttaccaccctgtcaaaaatcacatcgaccatcaacaacaattgtaatgagtcaaagtattgaactttgagattctctgttgatacagagcataatgtgacttacattaggctcttcaataactgttcagctctgagtttctcattgggtccagcatacatggatactaactccttgaactctgagaaaacactcttgcatacaataccacgcttccctgataatacagttcccactttgacaaggcctggcttctcaatttcagatctcgcctgcatataaattgtcaatttcacaaaaaaaattgatagactagtgataggaggcaatggtgaacttttttctgtacctgagcaatcacaaaaacggtattgcccttaaacttttcttctaattcgatctcaggcatatccacgagtctctctgcacacccattactgattccggaaacgagagcaacaagagccgttgtgtcgaaattaatgagacagtcttcaccaagcaatctcatggaggagattacagtagaaaaagcatctttttgacttagctctgtgacctctgcttgaactaaaacctcagtttcaggagaagcaagtgaatcacattgatctatcagcttgatctcaatagaaactgcttctttatatgatctggttcgaacaacgttaacccattcgcaatcaaaatcatcgagcattgagatatccgaatccgaatcagaatcgaagccaaaatcgaaatacacagctccgaattcatctttcagtttctcgtaaactgaagaagggagaccatttgcgaagaacagaatcaccgaagaaggtttaagcgtggttgtggaattagcagcggcgagaatctgttcgattctagatcttaaacctttgcttccatggcgatcaccgttccaggagatgtacctagggtttctatcagagacgatgatccatacaggaacttttccgagagtacaaacgagatcaacatgaacgccaccaatcggaagaggaatcggtttgcaaacgcgcgaaacgccggtgatagacggaagctgtaaaatccgtaccactgattcaatgtggccaatgttgacactgattgcggaaaaaaaatcaaagtcagaatcagagctaatgagagggagagaagaaagagatgattaaaaatagagaacctgagaggtttcggagaaggatcagaagagagagacgagagaaaggagagctcggaggaagcgagcttaaggagtgtgcgacggcacgaagcagtgattgcagttgataaaggaagattctcgattgttcttataaccgattcgcatctctgtttcgctatctctatctctcctatctccatgaccaacaccgtcgtctgcttaccggaaactagaaacgcgtcgtttaagttcagagagctcctccgagacacaacaacgaaagagtctaaccggctcaaaaccggtttgagtagctagcatatcgatattcggtccgatatccggtatgtttctctggccgcttgttatattccggtacataatgaaaatctcaacaaaattagttcagtgtaaccatatgattaatcaagtgatgacttaatttcctagactataaattgatcaacttgaatcttttttccaattggtactaattaatggataattagtactgtataatgatataattattatcttgctataaagtaatttagtatcattgtccacagggaccacaatcttaagtaaagtatccatcaaagagggggaaaaggagcattctttttgcacccataccttttatgttattaacacatgaaccccaagaaaagcaaaaggtacacaaaatctgattttgcttcaaacaaaatgaaaatcacgcaatattctttttttgttaacttgcttgcacactttcttttccccacttttatttctaacgaataatcttctcccccatccttctccttctactcctgtgagtcctgtccccttcacagcatattattgtgtatctttatatataaaatgtggattaaaccatgtttcaacaaactacttcatatctcaatcattcaatattcttgaagagactttgaatcttcagttgtttctgtaaaaagaaaaaaaaaac

SEQ ID NO: 488 - DNA, 3000 bp, Arabidopsis thaliana
cagatttggcgttgtctcaattttctctgtctccacactcccaaatgctgcctcctttaacccgttcatgcatgaagaaggttccagatttggcgttgtctcaattttctctgtctccacactcccaaatgctgcctcctttaacccgttcatgcatgaaggaggttccagatttggcgttgtctcaattttctctgtctccacactcccaaatgctgcctcctttaacccgttcatgcatgaaggaggttccagatttggcgttgtctcaattttctctgtctccacactcccaaatgctgcctcctttaacccgttcatgcatgaagaaggttccagatttggcgttgtctcaattttctctgactgatcgttttgacaatgatcagtaggttgaggagggatgataatatcttcaggatttttagctactgtgcgttttcctttctgagctttcttcttgaactgagccttcctggctttaagagtcttgacggtttctttaagcgggatagctgcctgtattgtcttcttctcacaaggaagtacagtaagctgagtgttgtagttggcaaggttgtttttagtgtctgactggatcgctaaaagagcagttctcccagcgctaatctcagcatcttttttagttcttgttgcagctcctgtgtactttatgcctccaatctctacagtacatgtgaattgtgtaactctcccaagagtttcgaccttctggcactgatacaatggaatcgcgtaattcatcttttgagcgtattcttgaagtaggttcttgcataatcccgtttcgtgctgcattaataagccattcaaagttagacaagagcaataacttacagaaacagcctaagaatcttccctctagaagttggcaatacacataaatccgataagacagaagacactttattaatgagtggattctttaaactcttgaatctcgatcattgtccaaccaagagcctagacaaatacagaatgccccctaacgtattctcacagctcccctttaaaccttcaactctgaaactaaccatgagcttccctttaaaccttcaacgctcaaactaagcataaggactactgctgagatggcaaagctacaattcgctgctaaacccctaggctaggttcaatagttttgcagtgaacttaacaataatcacgagcgaaataagaaagatgaggtgcttacaacaggttgtgaaacacattggcttagctcactggattttgctaattcccggagagcaacctcggcagctgattgctctgcagccttacgattgaagaatccaggcaaagaattatatctgacaccatccagtatcacagtcgattgaaataaagatttgtgtgaagggccttctttaacgatctcataaacaggcgttgggagcttgtacttctgagcatactcctgcaaccgacttttgaaaacatagcaattggaaacacctgagcaggaaaaaaacttcaaaatgaggcaaaagataaaacagaaacagtgatgatgctatccactacagcataaattgcaaataaactcaaaacgacaacagggaacagcagtgaacgagttctgaataaagctgacgactttcacaaagaaactatacttatccaaaaggggagagacagttttaaaccaagcttctatgttccctaacaaattgagtcaataaatcatcatctcaaaagagtaaacttgccaattgccagagagatctacgcttaaacccacaagggacagatacacttgtaaattctaactaatcaaaacactgcaatccaatttccaagaagaaagaagtgagtaaagaacagaagaaaggggaaaaagcatgatctggtttcaaaattaaaacccggaaaaaacaacccatgaatgttgaattagagataatgcagacatgatggtgaagaagaagaagaagaagaagaagtaattcaccagaggaaacatcagtggaggtcattttcacgagcagaatgtagctgaagagacgaataataggttagtagggcacggcgaagagcaagaaagaaacgtgctgctgctgcgaagaagcagagagagagagatgattcttcttcaccaaaaaccctctcccctcgacttcctcctctttactgatttttatttttgtttttttttcacaagggcaaacgaaagaaggtggttcttaattgttatgttacaaatgttaatattgaatttaatttcaaacctttataaattatattatattccataaatttacctttttggtcaaattttccataaatataatttacttgtgaatattatatgaaagcaaaatgtttttatctttgaaatatttaatttaattaaaaaactaattacatatagcctaatttcgtatttcatatgtagttaactaatgtatatatccacaattgattaacctttttatggctaactttattcactagtaatccctttgttatattcacacagtttttgtattcacaaataattaatttgttctccaagtaaacatcaataatgataataaccgtttaataaaaaataaaaacaatttgagcccatatttgagcccacttgagcctatgtcccttaacagaaaagaaaaatatttgagcccatatttgagcccacttgatcctatatccctttaccagaaaagaaaaatatttgagcccatacttttcgcttctgataagcgtagaataataatagtcgaatttaccaccttccttttcgttccttttttttcttctctcttccgaaacacctctgccacgcgagtactctccacgctcttcgacagtcgtgaccatcttcttctccgatcgtcttcaccggttttcttgggcattccctcgtgcgtaagtctctgtcgtttcgtttcgtctataactccctcgggttttggtgaaatttgattcctttgtcctgttctctgcagaattgttgcaataaatacgacgaag

SEQ ID NO: 489 - DNA, 3000 bp, Arabidopsis thaliana
tttacgttcttcgtacgttttgatttgaagaggtgcttaatggcgcttgaccttctacatatactttgtatgaacggctatcttcactacgcataacatggcctgcagtttcatctcttgcttcagcgatgtgatttcttttctaaattagtttctcggtaattgatgatattgagtgacaagatacaaaatactaagaagaaattctaatgcgaaaagagcataagcaaattctgtgtgcaccctcgctctccatgccaatgcagagacttaaaaagactacaatcctctttggcattctttttaagggttcaaaacagatgcctcgagcagtaaatagtttacaggttccaactgttgcgcatgagttcctaaggaagtgacagaaaccgtacaggattgccagagaaaacaattgctgtgagcattctggagcagtagctacaacgattggaggggcaacagtcacgctttctattcctgtaaagacaatatgcaagagatttgtcggtcacactgaatttagctatccagatttcttgaacaaggagcaaaattaaaaagataagcaaatacctccatgggagcagagtcatttgtggccggatcaggaattatcaggccagcaggaacctgtccaaacttcaaagcctatatatccacaagccaaaaaaaaagaagactgtcaaaatcaatcaaaaacaacatcatcaggcacaaatttgatattcaaaagaaaaagcaagggacctgttcgagtctggcaatttcttctatcgtctgagaattgataattgcagcctggaacatcatggaaatgaaatacagaaattactatcaaccacacagcgttgacctacttattataaagacaacaaaacagtgaatatgtttggtcctatataatttccagtttcgcaccttgatagctaatatttgctccgctgttggcgccaccactttcggagtctctggattttctgcagtttctgacacttttttaacctcctcccgagaaacctttttaacttcctcttctgcttctttggatgaaaacaaagatgcagcttcagctctctcctgttaggaaccaataatgtcaggtaaaaggtcttgctataaccattgtaaaatttagatatacaacagtgggctaaaggataaagccaaactattatccgatccaaggctacaaggttataacacgaggaaattaaataaaaacaccacaccctacatcaagtctggtttatatttatgccctaaatacaaaaaactttaagataatcaggcaaccaagtcatcaagacccaaactatatatactttaagcaaacccttttagctaaatgttgttaatattagtgaaatttcttatttcagcatacagatataactgtgcacaagaatcttaaacaacgtaagacaaaaggcagaccaatttcttgctctcagatattctatttttcagatgatattaaggttagctcccggtgacttgtagcatataaaataacattaagttggcatctagggtaagcaaaaatgaacagttgataaagcatatgataaggtccttaccttggctttgattttaatgaaatccagtactcgaagtgattttagcttgtgaatcacataaaggcgataatttgcctttttggtgatattattatccaacaaactaaggtactgcagcttgggaatggaggcaaggggatcaatctcaaccaaattcacaagcctgttatttgtaagaaccaaagagtgaagcttcggtaggaattctgcagatgtacaaccatacgataaatacaacacaggtaaccaacaaagcaaacaatgtgtttgaattgacatttcttacaacacacagatagatgttacctccaaggttaggatttatccgggtgatacgattgttattgatgagtaaagttcctaaacggttgaggtatgggaagttttctagcttaactatctcgttatcagacagatcaatggtatcgaactggtcctgtaagcaaaccaagacaagttaattagagaacctcaaacctgcaaataatctacctaagccaaacacaaaatttatgggaggcctttcttagagaagactggctctcaaaagtaaagaatccacagtaagaaaaaggtactattacacgaagccacatatactcctaaagagctagaaaacagatactaactaagacaaaggagcaatagctacttcaacaatgtttctgtcaatgattttcaaaatacttgaatgccgaaacccaacaggcagacttaagaacatacaatacaaccgcatcaacaaattcttcagctaacagacaaagaggaaacgaaaatcgatagaaaaaagaaatacctcagtagcacccaagttttcgattacaggaatcttgttacctgcaacaaattaacccagaaaaacgaacgattaaccagagcaggtgcgtttagggttacaaaaccctagaaaatgtaatgggaaagagaagaagtgtacctcgtagatccaattctcgctccttgatagcattgaagaagtgaggacttttccagatcaaatcagccgtgagcttcaccattattctactagggttttactgcttcgtcgagctctgtcgctgctaagcattcagaggaaagagacaacaacagtggctagagatgacataaaaacgcagcaaaatgacctttgctattaatttatcacttaaataaacggcccattgaattggcccagtcggttaggcccataagtgtatcccgatatttatgattttggaaattaaaaagaaaaaacaaataaaaagaaaaggactagtgaacgattgaatcttttcttcttcgttggttccaaccctaatctagggttactctctctctcgcttccttctgttcttcgttcttaccgagttccacgagcattagcttcagagaccttgaattggagtgcggttggatcaaaaacagttgagcgaag

SEQ ID NO: 490 - DNA, 3000 bp, Arabidopsis thaliana
aacacaaacccaatgttttatcttggtcacgtagagctcctttatcttccctgagcgaatacgtcttctacgttttgtgaaatccgtagattttcttttcgccgaggttaggatatttagtaacattaataattaagccatggcagtatgaaagagtgggattcatatcttagcacacttttgaaagatgtgagccaaattttgatgtagagagacaacaaatgaaattaacgaatttgcatttgaaacatatatagatcgatccattgataagctttaatgatatgtagaacacattctctaattctatgagatttgtaatgaagtgataacccatctttacgcaaaacacattgccgtaacgtcgacaacaaatgaagaatggctttgttaaggtgagttaaaaataatgttggcgcatcatatgtttctttaacattaatagacaaaaataagtaactcaagttacgttttgatgaaaggaaataaagtcgtaagcatgcatctctttgacgatagatgttgtgttgcatgataccaaactcaaacatattgcgaccacaactctgaaaaaaaacattaactcactcaaaattaaagcagaataatttttttgtttcttctcttttttagataaagagagacattttaatttttatgttagtcggaagattccgattcaaggaaatttatatttacttttttcgacctattttgaaaacaatttgtacaatcaaaaagatgttagaaaagtatgcgtaacattttttgttttttttggtaaaaaatcagggccggctcaaactttttgaagaccttgtgctgatttataaaaactggctttagttaatattggtttttaatttctaaaatttttggaccctaaaaccttaaagaaaattgaaattttttttgaggaccctgtgcttttgctcctgtagcactcccctagagccggcactgtaaaaaatatacgtaagattttgtgcaatattcgcagtttttaatcactgaattaccataaatttgttagacatttttacatgtttcttacagtatattagatagactttgattctcattctacatctcaataatatataatatatgatatgaaagttggacagtaatgaaatagtaatcatgaaagtgagactagctatttaaatgcaggtcacatgcaaacctcgtccctgatcccatcaacagaaacatggccagtgtactgtgcaaatccacaaactcccaaacaacgacactgtttctaaatctataatgcgttattcttttttatcatggccaaaaagtttgtgcaattagttagctgtcttgtacgtatataataatagaaattaatgaggaagtatatatgttgtgtgttttgtcaagtctctacgggccacgtccttatccataaaaaagctttgtgcatgacaagctgtgtaccattttcctttattcttttgtctttctacttattttctttcaatagaatataaaggtcaaaacatttgaagtcttttatagtcaaagatcaaacattgaaagtctttcagagtcaaagatcaaacattttaagccttaattaaggttaaacattacatcgacttgttaaggatttgatgatttacgagcattattaaaccgagtcgagaaacctcactagttaaagagtttattttgtgttagacgtgacgtacatgctgcatgcatatatgtaatttaagttgtttgcggcgagaagctgattttttaaaaattttgagacataatgttttaacttttaagctttctcaaacacattatgttcttgatgtatgaacgatagttttttaaatctaatttaacattaggttatcagacacactaatatacatgtaaaactttgcattatataggagccgtgactaccctatggcaaaaaggcaaatgcctaaagccaaaaaaaaagtttaaattaaaggccaaatttttataaaataataagcttatcaattttgttattttgataacaaataattgttaaaatgaaacttttttcgtgaaaattatattcttaactatacctttatctatagaccattttcttatcttgaaaacacatcatttagtaatatattttttttggtaagaatcatttagtaatacatcataattagtaaatataaatatttaaaacaaataacattattagaaaaacatataaaaacaaaaagaataacgtattattgatttttttacattgtaagtttttgatactaatattttttccgattcagtattatgattatttttaaaaactatgatgatagccacattttataaacttgtcctagccctgcacacatctaagcaagacactgcattatatatagagttgcttgtgtgtgttttgtcaatatttttacatgataaaatgatgatgcactctgaatacgatcccataaatatagaagtttaaatctaaatacgatcaccatatttacgtataaaataccaaagagtgtagaagataattattttagttttatagaataactataaaaaggtgatataatccacaatattatcatgtcaatatcttaagaacaatttgaaaagctaaattattggaagaatatgggattatggagcagtgagagacgtcaacttacaaattgagagagaaaagagtttcaacaacttttttttggcagtgaacttagaccgaactaaattccttcttcaaaagtaatccacaaataaattaatattttatagcctcgttttcaaattaaaaacagagagaaatttggaaattccagtacgacgggagataaaacctaacatacgccatggtgaccgttatctaaactacgccaaaatatttgaagtgtcgtcgtttcataataaaacgcaaacaaaaacccactcccactttctcctttccaaaaaaagaactctcgccactttctctgctctttttctttctctctctctttcttgttttcgccggcgatc

SEQ ID NO: 491 - DNA, 3000 bp, Arabidopsis thaliana
gtctctgagccgttgaggtacacaaatttgagaattgctttgtgaacaaaatctgattaaaatacttagaaaataaaaatctgttgaaccatttgaattttcaccatagttctatttgtgtttttcgactcttccgatcagtcatgtgatttatattttataggcatcaaatgtctttggaaagacacgggaactatattctagagattaggtcttaacgtatttcgtttcacttcttagaaattgtcctaatcttcgaagtgccccaatagttccaccgtaacagcttgagagattcaaaacccatacgatcagtttacgcattatttaagtaattatgatttgatgatgtaccttattttggcatttaaaagattcattcataggtaatctatattaaaaagaaaatctattacctttgactagcaagtggatcggtcagtcgatcggtcaagcttggcatgaaataccctaaatccgaccctagttctagaaaattagtctaatgtttgtagtgctaattaactaactactatgttttgtcgcatcaaaaatttggagttgacgttagttttgtcatggacttaacaaaagaaatttcaaccgtccaattgatattttgataaataagttgcaatatgtatacacgtaaacttaacattcagtatcctatttattggatgttactgaaaatgttatatgtattttagaaacaaaaaccaaccgatagttttggttttaggttcatctgaaatacgtacccaacatgaaaccagagacataatacatagtttgtgattttcataaaacgctattaatgacatataataactcatctttcacgtagatatttcttgttatattagtattttgcagtatttttttgtttgatttctactatggaaaaagatggaaacgctagacattcatttttttggattgatcacaatatctagaaagaaatgagaagagacattacaaatatctaagaggagagaattataagaccacctgtcccatggtgacgtacaaacaccatcaactttttcatattatttggtttgtttctatagtttattgtaataactccttatgtggaatccaacgaatcttatacgacaacaacaaagattagtgtaagatcgcatgtataaatatccttgacacttggagaaaccttagtggttcaataatgtgtataaccttaaaataatccagcaccatgatattcttttacttttaattatgctttctaagaaaatgttcattaaggaagttaaataattataataatcataatatatgtccctgcattaaacctctagatcatatacgtggcaacaaaacacaagttgtaaataactttagcttaaccctatcaaaaagataaaaatttagattaaaaggattattctattggatttgatgccttgttaaaccatgttacctaatgccttaacattatttctttaatcttgcataaaataatggatcaaaatgaatagccctgtaatatcctcgtttcgtgtatatgagaatgatgaagcttgggtggcttaataattataacatttaaatttgatttagtttcttaaacttttcaatagaattctaactgaaatcaaataaattatgctttggatctgtttagtttttgatttaggctgaattcgtttatatatatatatatatatatatatatatacaaatataatttctgtttgatttaatttatttttcttttttttggtttaacatattaaaaacaaaaaccctaaaactaatgagtttaaaacttgtgtagtaagtgaacggttatcttggtctgtcgaggttatgtaggaaagatactctttgggaagaccttttcagaaattttgatgtgggatcgatagctcgtaaaattcttctgattcattccaccatatgcgtaagaagtatttgcttatagcctatagggagacgatcagatagtgcttcaagggaaaattttcattggacccttcactgtttcatttgaagatgaaaattttgttataggttatgaagaatatttttctataaggatatatattgataggtttttgaaactgattgtgatgaagtagccacaactcaccattgttacgtctccttggaattaatccaaaaaatttcaacctaccatgacactagtttacaatgtgttaacttttctaatttctcgggttttattaatttctatacttgtaattcccatacagagactattaagcttagattcttagaattgtttttaaaaaaattaaacttgtaaacttttgtctttcagatttggttagcaactaaggactcaaaatgtagttggagaaaagaagaaaagttttggtttaatgtatcaatgcatgttttcatccatgattaaaactcaaaagaaatataccaacaagaggggtaatttagtaatttgtgtatgatgatgcctttggagatcaagagttgaatggacagaggaaatgatacatacgaaagacttatgaaaacgaccagtgaaaaggggtaacgagagcacccaagttctcgtaattcttttgtgtttacattaaattctaattattgctaattaagagcttgtagaactatttttgtagtttaaggggaaaaaggtatgtatattgcacggaattttcttttagttagtggttagatgatatttatgattctaaaaggtacacaactctaaaaatgtaaaaagattgtcttgtcactagtctatatctctatagaaaacaaacaaacaaaaaaagtggtggagccaaggagctagagtgagtgtatatataaataatgaaaggggaagaggaaaaacagaacaaaacacaacacaaagacaaaacagaggaacacttaggtttcacaagacagagagacaaaaagagattggtgggactgttagagaaggagaagacactacttctcttatttagctttcactaaagaaaaaaaaactaagaagaaata

SEQ ID NO: 492 - DNA, 3000 bp, Arabidopsis thaliana
cttttctttgccaggacaatgtgatatctactcctgaaataaaaggaaccattttacccggtattactcgaaaaagtatgatagacgtggctcgaacacaagggtttcaggtgacctcttccccttctttaaattcccaacatctttaaagtggatcataagtactattattggcttctgatcacagtgcatgtttatacggtattgttcaggtggaggaacggaatgtgacagtggatgaattgttagaagcagacgaggttttctgcacaggaaccgccgtggttgtctctcctgttggaagcgtcacttacaaaggcaaaaggtaaaacgttttttctttgtatcccaatttaagtgaaaaccaaacctaccaagtggtaaagctttcccctttttccgaatacacacacagagtgtcttacggagaaggtaccttcggaactgtgtcgaagcaactctacaccgttctgacaagcttgcagatgggtctgattgaagacaacatgaaatggactgtgaatcttagttaagccaggcgaatgcattgcatcaattcggctgcttggttttgctttcttttctttggtctgtggttctgattcgtgaaactatgagttggattgtttagaatctggttgatctagaacttagctggttcaagatcattagatgttgttgcatcataccaataatattatctttagatctctgtttctgattagatggttacatccaattatttctctaaagtctgagacatcattgatatctaacaatcaaaaactaaaaagtgaagtattaacattttaatcagattcaaaccagaacttatcagtcatcaaaaatgttggcaaataacaaatcaaacttaagtttttggatggagaaagcaagctagattcgaatctctaagaagcgtggacttggacttgtttacgacctgaaaagatgtcatgattatctcatgattacgagataataacatgtcttatctactaaactaatctaaaaagtagtgaggatgacttgaaacttaagtcttatatgaattatctttaaatatagaaaaagaaaggagatagagaggtgtgtttttcatgtgaacaacttttttttacctttagagtacttccagaagacttattgggtccttaataaaagtagaccaaattattgaagagctaaaaaaaaatgcctactcaaaatatccaaacctcttcttttagccttttgtttttttcaatattcatactaatgtaaactacaatcattgtatcattctataatcatatgaattttttgtcaacaccatgcattatgctagtttaaatttaggtgatgatataaagatattttaagtacaaatcaataggggcgatgttcttatgtctttatctaactttatgaatttgtgttttatatattatgaaaaattggaaaagaagagatggcctacgctcaagaccaattcctaccaatgggcaatggtgttgaaatctgaacaaaaaaatttcctttctttaacgttagctttaaagttcaaaaaactttatttactttttcagtgataattctgtataaaataacatataacaatgaggaaaaaactcaataatttgaatcgcttatgactttatttctccaagtgcttgacttttaaaaccctaatgtccaatctcaactaaagtcaacctttttcgttcgtctagaagagtcagtcattaagtttcaattgaagtatacagtaaattattagtactttttattttattttaaccacagttcattggctgtatgagatttctgttcaagaaaacatataaatcgaaaccaaagcaaaagacattatttgcttcggtttcttctactcaagctcatttttagtaaaactaaattgtattttcattttcttaaaaagttaattgttttttttgtaaaatcagttttaccaaattggacacaataatgaatatatgtctatgtctagttttttttagctcagaatatatcttatgtgaatagaatcgtctatcagatatttttgtgatgcagatagaacttaccgttatagaatcatttgtagattgttcatcgtgattgttaagattagattcccatttgtaatataacagaaactcgaaaagtacttatattaagtattaacgatgtatcatgtgaccaaaatagaaaatactacgtaatgatatgattattaagcgagtgtgtaggtaattcaaatatttcaattaatcaatctttgatatcactctttagagtaatgtattatctttcttattgttttaccctgggattaataagtttaccggatccggagtagaatttcttcggtttggcaattttgttcacctaccataacgaacttttacccttatacttagtttcaatctacttttggtgcatcctttcattttcaactgcaaagaagtagttaaaagatccaatacataatatatttaatttatcataagtaacttagtgtaaagaaagactaaagtactttttaaaatatgtatttgtatttcccgatgtgaaagaaaagaaaattgaatttgcacatatcaataatattagctaggaaaaaacttgtgagaaatttctttgacgacttgcgtgtgcaatagtcttccttatcttctctaccatttcttaattccactattgtatagtatttacttatgttgaattaataaattaaaacatttaaatttccctaaagttactttttgatttttgattttctatttttattacaactttcctactttttgacatcttttcttacaaagactttttgacatctccccctccagctattatatagtctccttttttcttttctgcattcacataatatttcccctatatagtttacacaacatcatacccaccaacatatataatcttgatcatagagagataaacagaggccgctatcaagaacaagactaagaacaagacttcactaggagtacaagt

SEQ ID NO: 493 - DNA, 3000 bp, Arabidopsis thaliana
caaagaacttgtaaccacaaagaaatgtacattgatgacaaaataatcatagatctataacgaacttttgaaactaccatactttgaactttcatagcttaatgatattacaaatcgaatgcatgaaactaattaatttatatttaacggccgcaatatgagttctacaatggtatctgattcctgttttattttgactcgtcatcacatattatattcttgttttcatacattattatttattcttttagctgaaaagtttcttgaagtgatattatatatgtttgatcaagtagtttatttaattgtaaaagataatgtattctttttatgatctttattcatgtatatcttttgtgttatggagataagtaaaagctaaactcgaataagaaacgacaaatgtgcatcttcaaattttcttttcttttttctcaaatggaaatgtactaagtaatgtggcagtcttagtcttttttttttttttttttttttttgtgtcttattcttagtcttgtttgggcaatggtttgtgttctagacagacacttggactgttccattttgagactgattgctccaaaatctttaagataacaaagcatctagagaactgcctgatttttccatgccattagatgacgtttttttattataagttagaaatagatttcttaggtttggtgtatatctcacatactatatagttcaataaacttttcatatgaattgatcaaggaaatatcaagttgtgttgatcaaaaatatcaataaaaaagatcaagaaaatgttgtcataaccacgtggtaatggtctgttatttttattgtattcatcaatgaaaaagatcaaccctatggttagcacagtaagactagtacgctacaatcataattagtaataaggatatgcataacattagtccaaacttcaagcgttaatattatgttatcataaaagtctcttgttccgattacgctgcatctaactaaccttgttttggtgttgctaaagagagaaaaattagcaaatgtagtcaaggtcaacctacaagaaaaggctatggatatgttccagctatagccaaccacatatatggtttatgcaaatcattgtaatcctatggtgggaaataaacacgcttattagctgatcaataaaataatagagattagaaaaagagtaaagaagtgataataaaagtgaaaaaagttttatattggctttaaaccgggcatgaaagttacagtccagttctatggatcctcgggtcaaagttttgcagttcaagatgtttggtgtttgcactacaaataaaataagagatcatcacttatcttacctaatcactaccatggttattcatttgtaatatataaaaaaaaaaactttttgcaattgtatttcatatgtttcacttttaaaatatgtatagaaacttatatattaaacagaaattataacatacaccggatcaagcagatagattttcctaatgataggagaaatttaggataagatagtaaaaccgaatgtctttcttttttctctttcagaacttttaaaactctccaccaatgttgagttatatgtcttatttctctcattttcttgtctatcagatacacgtaattcaaaatttagacgtttggtgaaaagtgaaagatctctcatatattgagtggcaacaatgtttatgatatcatcaaactttttgataacaatacaggaaacgttttcagaaaaaacaaaaaaccctgctatcaaacttggacttttggacttcggtttagatgtgtaatttgcggttcgcttgcggaaaaatgtttcctaaccgacggtactgtcctgtatcttcgacgaccgtgtatactcggtactaaaagaagaaaggaaaccggcgttatgatactcggtactagttagtgataatagtgctacaatcttacaaaactatccactggtaaagagaataatataggccacctgtcttgtggtgacgttaaaaggccgtaaactgtttcaaacaagtacataatttattgctaaagtcctgacgtggaatccaacgaacataattaaaagaaaaaaaagacttaagatcgatagcatgtctaaatttcctgaacacttggacgtatgttactggtctagtttaatatgtattactccaccaccaccaattgttgttaattttttattatgtttttaaccattataattaagggggctacatatagatataggcctctttgaacccatagatactgtacgtgtcacatatctaagttcaactttttttttgtgaatctctctgttgcgcaaaaagagttttggatttgatgctttagaaatcgttacccaatgcctttaaacatttcatttttaacccctacaataccctttttagaaaccaatgagaccctttttcatttaaaatttatattcatatgacacaaaacattttctttcttctaagaatatgacagcaaatattacctatttatttgttctgtcgtatatatgtattgattaaacaacttaaatttataggctgatatgatctagtagcctcttttatccacatagactgtatacccttaatatgttataggtttttcatccttgaagtggggttcttttgatacgatgatatgcttaaaaacatagactatatatctatctatatatatcaaataagaataatattttcatacaaaatataatatcattttcttttgatctccctcaccatctctcttaacataaaaacaaaacaaaaaagatagtgagggagaaaagtggtggacccaagaaagctttgtcagtgcatatataagaacataagacattaagacagagtagcacagagcttccataacaagacaaagccaaagagcaaaagagatcggtagatcttatagagagaacaaatttttcctcaaatcaaaatcagaagaagaatgagttggtggggagtgaaaggaggaggatgggga

SEQ ID NO: 494 - DNA, 3000 bp, Arabidopsis thaliana
ttcgtcttaagtcgctgtgccagcaacaaaggctactacggagagaaacaatataccatagtaaaatgaaaagtgatctctgtaaatggacaccagcaacgttggtagttatgatttgaaatcgctattatgacacctctccacatacttgggtcttaagcaactatactcatagctttttttggttgctttactgtgtagctgcgacatgcagaagtacaaggccaatagcttacacgttaaaagggttggttcttctctcacaaggtataaaacaacactttattcataaatatgtatattttttttgggtcaaaattcataaatatatattgaaatttaagtttttgatggtagaaaaaggggttaaatgattcatggaattggaaaaactctccttaagcttcgcctacttgctgagatgtttgtttgatccaatgtgggtaattgtcggaatgcaagcatctggcacgatgcttagactcatcaaatagttaggacaagatagaaacgtctattgggacttcccattcactcacgagttgttgatgctaatggattatgggcttatggccctcaaaaatagaaattctattatgcgccaagaacagatctgcttcttggcctatatatctacctaacaaaagttcaagtcacggttgttcttgggaactagactagtatacttggactgttgatggtcaagaaaactccttcttcgcttccagctttacgtgggaactgggaagcattgtggtcacgggaagcggccaaatattggtttgatcactgatgagtcttgctttcaagatgtagatttgtcaaatgaatagactaccgactatagtttggcttgcttcatggggtatgcagattgcaactcactgttgtcttttctctacttatgatgaaaaccaaaaccacttccttgtgaattgtgattactacaagttgattagacgatccatgcagacccgactcagcctcacaaccaatatgttctatatttgagactctcttattgtctgaacaaatctaggtacacatattcaccgcccatcctgcaaaagctagtggctcaagccactgtatatcacatatggaaggaaatgagcaatataattcattagcaacaagcaactcctgctacaataatcttaattaaagaccattgatatgtaggcatattccataatacaattatcgccaaaaaaggacatggaagaaattcattaacctaatgtgaataactagggttgcttcttcgtcaaaagatccatgtgaccattgtatttttttttccatgtttggcaaaacacaaatatagaaggttgacattatgtaaaaccaaaacacttcattttctaatgatatttacattcatatcatattatataagtaaacgttgaatttgtccctcagtatttgaatgcacctagctaggttggctaaatgaatttgaattttatggtcaaaccaatgaacatagggggaactggagaagtataagacgtatatgaacatacagtatagtatttgcaacttgtttgaaactggaaaaaagtataattaagttattacgacaacttataaacataattaagaaacagaattacacgcatgaaaagtcgtaaaatgtcaaccttcaaagctatagtgctgaattaagtgctaactaagtatactaatcaaccctaaaaattaattaagtcctaccacgatcctataattaatgttcaatttgcggcatttggaactttattcattaggataacgcgttgcatgacataaagagtcaaatgagatattttattactcatagtttagttattttcagtgtatagattcgattaatatcttaattaagagagtaaattgacaaaatcataaaaatacagtcttcatccttggattttggcagtacttgtactggatctttaacggagaaatatttaacgataaatatttcttagaatttaagaagtgaaacggataatttggtttatttaagaataatgaattgtgcaacgatgggtgtatttaggaataatgaatgtgtgcaacgattggtgtatttaggaataatgatgctggtcatgtctagggatttggggtctaactaaagcgaatgtaaatatgagaaattttacatctaaacaatataatatgtattgtaaatttgtaataaaatattttgtaaaataacaaacatgatgtttttttatcaatgaaattgaatttcgaaaacaaattgcacttgatttttttaccaatacataaaatctaatttaaaaattcggtggctccaaaatttgcataatattatgaatcctaagactgttttttcgatcagtagacatggtctagtgactagaatggatgttaaacaaccgcactcggactaatctatgttcatatctatgcaaaatgtggtttcatttccgccttggaaaatgaataattttgacataaacggtgtcagtttaaaacacaagcacgagaactagttcgattattaaattgaggaaactgttttgttccggtattttgttcatatttcctgaaaccaatccatatttataagatatctctttttatcaacaatatacttatgcggatttaaacacggatagtaatattatgatgatgttctcctctcataaagatagttgataattacaaatatattaggagatgctctatgttttaaagtttttaagttattgggaaaaattaacaattctaatattgcggccgtttatgcctttgtcccacatgttacaaataaatcttaaaaaagaattatcatctattttgttcatctataaaaccatcaacttctccatcttttcctgtggatacaaacaacatcatccattatctctctaaacataactccaaaaagtgactcttttcatttcagaactcactcaaagacaagtacaaagctaagtcttgatttttttctttgaatatctctttgtgggtcactcttcatca

SEQ ID NO: 495 - DNA, 3000 bp, Arabidopsis thaliana
gagaaatgtagatatgacatattactctatatatatattagccgtaactatcactggagatgtacactgtaacatataaatgattgggggacaaaggtttttctctaatagtatatgatcaaggttaattaaacattctgaactggattaaggtgatataatatactactctctaagtacggtatggtaccattaccggccatgtaacacaagcttaccggtttaaaagacataatctatttgactaaaatgtaattaattaattagggctccctaaacactgttattaggaaatgcgatccgtgaaatggggaatgttatgttgtacgaaactcggtaatggatttctttgacatgttccaagattcttcataaaataaaataaaatcattatggtgttttgaataaaagacaactcatgcgatggtcaactactgtgatagaaactcaccaataaaatcaatttgacattctttttgaatgaaattttgttgctaagggaataaattaagagatgcatggtatattttagtgatgtaccatttaaccatcttgtaaaatatactcatttcttttctcatttattataaagtttatataatgcattatttgatactaattatgtatacttattatttttttttattttttttaatgtatacttatttcttatgtttaaatgtttatttccttaaatttaatcaaaaaaatatgtttcaaacatcgatctgattaattacaaataacctccatagaatctgtgctttaaaaagacaagcaactatgatgatcattaaccaaaccgaaccaaattgggagcaatcggagatctcacgtgtccacttttcattaaatcataatgaatagatctaacgtacagtattaagccacgttaacaaatcataatggagaagacagattcctcgagatcttaaaaaaaacagaaaaggaaaataaaagaaaacagtaaagagagagagagagagaaagaaccgaccaatgataatgcaaaacgcggatctcacgtggacccctttgtacaacttggccatgaaagttaccgctgatctcgaccgttcatttggcggctccttttccctcatctgacacataaaatcccaatttgccaatattatacaaaatgtacgtaatcagtgaaaataaagattataaaagtatacagaagcacgtatatgtttgttgtatattagtttaatatgaatgttgaaaacttggtattgttttttcagaggcatcgtacactcccacaaaatgtcaacttcgcgtatttaaattaattaaataattatcatacattgtttttgagttttttttctcccttttttgtgcctcaatgtcaattattttgtatttcacaatttatcagagtgttcaccagcattattattttgtaattatatcgttcacggaatttttcttcgattcattttattttctttctcaaagttccaaaattatatttttcatgtctttccgtgtgaccaaatcaaacacaagaatttacgatttcatcattaatcgatttacatttagttcgaactctaacatatttgttacgccatttatactagtgaatatgtaagacagttataactgtaaagttctaactatactaattacttttccattgaaaaagcttaaaagtttttagggtccaattaagtagctaaagtttaatcaaaatgatttcaaaagtagtagaaaaatatgcagttttgtttaaccggtggtgaaatgatgattatgaaattaagaaaaaaaaatgtttatgattaagaaagagtttgtaactatgtataaggagtaaaagtaatcttgattaggaaaataattttaaaattacagcaaacaatttagttttcattttcaataatagtgaatataattaaacaatttataaaataaaataaaaataggagaaattgaaaaatggaccacatttggtgtatagatagacacggacggtagtgagcaattttttaagcggttcataaccactttattttaaattttaatacatgttttaatcatcttttctcatttcaaatatctatttgaagcgtccgtttaaaactttcaaccattttacccaaaactgttaagtcatgagtatttttaactattaagcaggaatattactatgcaaggtgacaaaaaaatagaaagaagtaaaaaagagaatcaaatcttaaattttaagaagaaaagaaaaaacagcatcaaccaaaaataataatttatcaaggacagaactataagagcccaaatcatcacctcctttctctgcctacttctctcttttttttttaactcgagaagtttataatctggtttctgattttagttttctttccatttatgggttcatttgcttcttcttgcacgttatagttttcctaattgggtaagctccaaggtagcttcttcaatattaatttcatttttttcattttctgtagccatatgtttattttcccgagaaatattatccacacccagatctttaaatctcttttaactctgagtctctgatacttaaataccactcatgctgcttattagctccaccaaatctggaaaaccaatagattctttttatttcttctgcaaaaatctcagagctaccctaaaaattctctctttttgactcacttaccagatctccactagattttactcaattctttttcaaaaggtttaaacttttatagattccttgaagtgggtctaagcaatgcttcagagaaattccgatgatttcttctctaaccaaaataaaaatgaagtatcatttgatagtgatttttgtgttcttcttttgattctcttatctcttccttcccatcaataaacccaaaaaaattaatatcatttttgggatcttattgatcccaaaattcgtaaatccgttgacctttgtcggcatgatttgttcttacttaccgtaaaaaaaacagagctaggttttagttttcggac

SEQ ID NO: 496 - DNA, 3000 bp, Arabidopsis thaliana
gtaaataggcgataacattataataagttcaataatacaaactttataagagtttattgaatttttgttgggaaaattgaaaaagaagggatggcctacgatgcaaagaccaattcctgtttcctactagtgttgttgaaatctgaatacacattttgtcatgttgattagtgattacccttagcttcaaagttcaaattaactttacactaacttttccataagtaaagatattttattcatgacgatacatattttattctacaaaaacatataaacagtgcattgtacctcaataatttgaagactttatatttttccaagtgctttgacttttaactctttattaaccatcaggagacaagtcaacctttatttccctctagaagcctttggctaatttattaaacttaaaaacgaaccaattaaaagttacaattcataattatttttgtttatgattttttcactattattaataggctattcgcatgtatattcaatcgtatttcacttgttttgcaaggaactaaattataataaacaatacacccaaattgaccaacttatcttacacaaaagattaagagcatacgtttatagaagaaggtccaaaaaattgtgacgccatttaataagaggtatagtgggttttcttgttccttaatctcagctgccgtggaaaataagtgttagtagtaaatttattgaattaaattataatagttagatttgtaacatccctatcaaatctttgattaaaatttgattttgggtccatgggacaggcgtcattaggttcaattttaatactgcatgattattaagtggctacatttataaatgaattaaacaaacccatctatcaattcagtattgtcaccgtgagtttgaaactttgtcattttataagttataatccgttatattttattacaattttttctcttaaggagattaataatagataaaatcgtacctgatccagaaaagttttaatatccataaatttgttagtggtaaattttctccgagggttggcaaaattttgttcaccaaccgtaacggaatttacactcacaaatttcaatatctctaccttcttttcatctcttttggtacatatcattaactcctttccttttcaaaagacaaatgtatattaaatagcaagtgattcaccatccaccaaatgtgatcttctgattagtgatatttctttagacaatttaattgatggatttgaaaggaaaaaaactttgatatatatagtatgaagaagtttctttgtatttatccaagaactgttagttcaatcacttgcgctttgtttacgaatgattaatgacgttaactattcaaatacgatgctactctgttgttgaattcatgcgctttgttttcgtctttgatttttaataaatttacatgttcaatacaaatatcttttttattggtataacaaagaaccatgataagactgatacataaaataagatgttgtcatgttcttatttaactactatatacttatattgatcatgctcaatgggagtttgtgtatataaaaataaatttagaatttttctttgtttttttttttttgggcaaaagaatttttctttgttaattcacacatttccatcaccaaacattcgaagtatttgtctctatctcgacaacatttatatatatttttttcttttttttgaacacgactcgacaacatataatacactcctttgtactgtatactacaaaataaactactaaacaatattgactctataatatataatttatatatacatacaatacaagtctaattcaatcacttttggttcaaattggaaaaacattgaattcttctattattcttgatgaccaagtctatatcacatgtaataaaagtacacataaccggtctttctttcttattcgtaagctgccatgcaagtggggcttcaagctttcgtaaaatctctcatgtattccacattattaatcgaatttaaagtattttgcatgttatttagattagaaatgtcgttttcttaatcacactcctaaactgcggatcagatataatcaccaagattaaataatataaaaatataatcactacttgccaagacatgaatcatgaggaaagttctatagcgtgtactaacatacaataaatcatatttatgcgtatacatttactagaaccataggatcgatgaatcagatgcaactcatgcagtcatattacaatatatatttagatatgttcatcttgatctttcaacttaaaactcgttcatattcatcatttaaaaaaatatatatatgaatgtaaaaaaatggtaatttaaaattagatgagaatggggaacaaattaatcaccaaacaaaaaaaacggaatagagtaaggaagagagaaagagtcaatgagtgggggcggctaagaaaacattataagtttataacttatgagttttatgattaggaaaattataataaaacttgttgtcgaatagtaaaattataagaaaactaagatattatttctcagtcaaattataaatgatattgaatatctagattctgatgtaggagcaaagacaaaggagaaaaacattagtctccccccttctctgtcatttcttaactctactaatattttatcacataatttatcatccaattttccaattccataaagtcactttttgattcaattttattttaattccctatactttattgacatcttccatcacatgaaggactatctcctccagctattatatactctctctctctctcctttattttttctcaattcacatataattttcacctttacacacatttccatgtaagtatatataaacctcacacacgcattatcatacaccatcctcctcattctcttcatcatcaacataagagagagagaagaaaaaaagaattacaattaataagaacaagatcaagaatcaagaatcaagaaa

SEQ ID NO: 497 - DNA, 3000 bp, Arabidopsis thaliana
tttaccaaaactcatgagattccgactaaaaacagagagataacaagtagatagatttatatatcttatacattaatttagatctcatcttactttaggcttgacctgtaggattgcccatctcgaattaaatccctcttttagatttttttttttttatcaggcaacatactcatgtcgggtcaattggaataacatctgttatcatataatttttagtgagctttcaattcaaaacctgtaggtaatatgttgattggtatgtgtcttttatattatattttaatataatcttagatgtaagattcttataatattttctatttaatgtttttgtggttgaagatggtggaaagacattgatcttccatataagctaccttacatcagagacaggcttctagagacctttatcggtgtcatggcggtgtatctcgagccacactattcacttgggagaattatagccactaaagtttcccaagtgatagtagttatggatgacacctgtgatgcatatggaactttctctgaagttagaagtcttattgattctttggaaaggtagtttactaagtatgaatcatgtggtcttataatgacgtcattttttaacgagcacatgcatgggaaaatccttaggtgggatcctggtgccattgacaaactaccgagctgtttaagaatcgtcatccaaagtatagttgaaacaatggaagatattgaaagagaaatgaagccgcgaggaagatcctcgagtgtgcaagacaccgtagaagaggtacaccaacaattttagggtttagttttaatcaatgtccatataaattaatgtttgtgtttaatattgagaattttgcagattaagatcatggggagagcgtacgctgaaatatcaaaatgggcacgagcaggtcacgttccaacctttgatgactatattgagcttgggcttgactcgtcagggattagatgctttgcaatgtacagctttatatcgatggaagattgtgaggagaatcaaacgaacgcgtggttcaaatccaaacccaaaatgttacgagctttaagtgttatatttcgtcttacaaacgacatagccggcttcgaggaggagatgaggagaggagaagtggttaatggggtgaactgttacgttaagcaacataatgttaccaaggaattggcggttcgagaaattaagaagatgattagagataattacaagataatgatggaagagttcttgacgataaaaagtgtgtcacgtccgattctggtccggtgcttcaacattgtacgattggtcaatctgtattacgaggagggtgataatttcaccaatcccaatggcaagctcaaagatctcatcacatctttgttcttccatcctcttccgctttgaagacttggctccttgccgaaaaattcatctacatttctctttccattattattgatgattgttaatttgctctatgcacatatttttccattaaattttaattcctggggtttcaattagtttttactattttaatttattttgcatagaagttttttttataactttcactacccacaacgacaaggaaagttgaccaaaagaatgaaataatatcataattcatgtttatatacgttatactattcaattcttaattcatgtttatatacgttaaactattcaattcttaattatgtttctttgcaaataatattaaattacacacatgagttcttgaaccaaggaacgtataagttcaaaaaatagactggaaagcaaaactttgttatacttgttgagttcttatgtaggatccaaatcttgtagataagcaacaatatataatgggcggtgagattaagactgaaagtatttttttgaccaccggatggaccgtacggatttccacaattcgatacggtgtggttgttagtgccttagtggcggtggtgaccattatgcagccatttaactatttagggttggaatttggctcatgaggttttactacacatcaagaaattatttggagacagagcatcgatcttctgctggtcgggttttagaatttcataaaatcaaattttggttaatttagatgggtttctttccccaattcttcgttatgaacaattcattattttggtcaacttaattgtctatgactctatgggcagttacataatgttactatcatatttgctgtcaagactcttgagatatggcatatatggacttttgtacgagaacctaaagttctaaccaacacatgatataaaggactaattgcttttcttttcatttggtcttacaacaacaaaacacaatatactactttgacttaaaataattgatcttttatatgaaacactaatttatctcagtatgaactatgaaatctatttcctagttgaaaagtttaaatattttgaactttttgatcaagttaaatatctataatctaactaaggcccagaatataccaaatatgaaatatatttatcaaggccatgtcaattttcttggaaggcatgtacaaagtttttactgaaaacatatttgatgtgtaaaaaaatatttctaaaaaaatttagaacccaaatcatataaatatcaaacttgtcttcaatcaaaaaaataatattcaatcagcgttttctttcaaatacacacaacacactatttgtacacgcttaaagacagctttgctaatgtacaatatccatgtaagtaatagagacccatgcatgcatgacagcatatttccacttcacaagtaactacgtaggaagctcacttcacctgaaaccaaacaagccatccacaaattctattccctcatttattgtcttctttatttctctatatatacaatttcacttaaccactgactctataactcaaaacttctaaactaattcgcacagttctatatacactcacaaacacacacacacacaatatagtgctactaaaataaccttgtattaatt

SEQ ID NO: 498 - DNA, 3000 bp, Arabidopsis thaliana
aaaaaacattcgtatacccgaaatggatcttctcgccacgcatagtgctttatgtaagtttacccaatgttttttctaatttaaatagccttcttaattcctcaatcctcattacaacatcatttgcttccatctttattcattgttttttttatcaaacaattcattcaatcattcttcttctgtcttagtattttctccaacaaaaaaggtttttaagattatggaaaacatgtttttttttctgaactcgttcattttttttaccttttctttctctaatagattaggagataaatgaattgataatttagttataatcagcataattgattttaatattaacatcatagtttcacaattgttttttcagatttcataactcaaaattttagagtttagtcagaaaaccaagttgttttctgagtatatatttgggcctctgtcaaaccaaaaacaaatctaaaatttcttaataaaaataagttgtttttaaaatgggccttttatcctttttttttttttgaaaattctaatgaatctatggcatttgcctaatctgccacgggagagagaccggtatgtgtttaccctacaaaacattacagagatatgatcatataataaagaaaatagttaataaattcataataggataatatacatacacgtacttttaaaagagagatagttaaagttcttttgtagctaaatgcagagaaagagagagagtgcctctttcgtttcccccgtttttttaacttgagttattccctattttgctatttttttacttgtgtttttttatgtttttacttttaattttcctatgttttgatgtatatatatagagagagttatgaacgagagagagagttatgaaatttacatgatcacaaaacaaacggttttatgtctatagaatcttgaaaattttaacactttttctaaatgtaacaattaagagagagagataattattaaaattacacgtcacaaatgtttttgtgtctaaggaattttgaaaatttgagactcaccatctaaaattcattagacaacttttttttaatttttttctttgaaattcaggagattctgggccgaatcccgtaatcccccaagtccgaaatcattagacaacttttttattagaaggttgacaatttgaaaatttcctagcttttatctttctaattaagtttacctctttctcatacatacatgcatcaaaaaaaaattcacccgaatgaatttgttaccaaaacacatgacaatgcatagaaagatttgtctttagcttttataaaatatttgtttgtgggatgatcttttctttttagatatttccttctgtttttctttgctgatctttttaaagctttttcaacccactatgatgttgttataatttagtgtagaaaaatatctcgtgaaactctaaaggatgaaaactttagattaacattgatatctctctcttaattagttactcttcttaactccttttataaagacaaattaactactcttccatgaaaagaagagctgtattataggtctatcaaagttctaaacatagcctactagagattttacacgggtttttcgttcactaagagagaatttatacatttttttttgtttttggtaaaaatttatatacattttcttttatagacatttcttctcatatacttcatttttagtgtttttcaaatgtctttagctttttgttcttgcttatgatcttcgttagggcatcacactaaatatgatatgattataatttagtgtatgataaaaactactttgtatggatatagcgtggacaagatattgttgatatatatttaaaacaacttcttatgatcatatggacatagcatggacaagatatttatttgatttaatatttgaaatgtctttatttttttaatcttgttagggtttcacactaaatatgatatggttgtataatttagtgtatgataaaaagaacttcttaacgaatgtgaaaaaacaagaaccagaccaattaaatataggaaaatttacatttttaaccctcaaaatatcatttaaatactatttgggtgttatttgtgttccaaatatatttatgtgtaaaactttttgggtgttatttgtgttccaaaaacttgattaaataaaacaattttctctttaatatttattttttacactttcataagatgtatgtaaatatttttttaactataactaattaatactttttctaaataacaatttatgatgagaaatgtttagtttatgtttttctaaatttaatatacaattaaaaaaaaaactcgcatgttggacaagtataatctattgttatatataatcatgagattttttgttccaccattatcgttgtcaattattattctattattttcgtttttttctagcatttatctgtttttacttattaataaatatattttcaacacattgttttaaatagttttgtcaaaatatttaattttccttctggtcttctcagcgtttaccaaccaaataaatagagggccaaaggtggtagatgcatgaacctctaacaccaccacaacttcaacacaattaaactcgtctctctttatctttctctctctctctcttctgttcattaacaaaatccagaactatatgagaccttgttgtcacttaccaccttcttagaggtacctcaatcgtttccttaattgctcagattttccggtttaactctttaaccggtctctgttttttttaatatcccctaaagctttgattttgatgcaatggattggtttctattgagtttgtgtgcaatgggtatgtttagtttttgtcgttgctgattttgtttctctggagaagactaatccattctcatatttggcttcttgttttttctttcctcttcttgattggatcaaatccatgaacccatcttctgttgactctggtttttagatttagcttaggttt

SEQ ID NO: 499 - DNA, 3000 bp, Arabidopsis thaliana
aattaatctggtgtttgcctgtttgtatattcgtacagatctcaaattgttatttcttttttgaattataattaatcaagacgtataactaatactctctctgttcatcttaatatgcattgcaatatggtgcttacacaaaaaaaaaaaaagcattgcaatatgggaaaaaattatttattatccacataaacactgttggtgataaatatttgttatgtatagtaacattgtatgcttgaggtacactgaaccacatttttttcaattcaccaattaatgatgtgaataaagacatcaagacaaaaagaaaaaaaaaacagaaaaaaagacatcaagacttcattgagcccgtaaccaaaattatcaaaacaattattatcccttcatatatggatgtaagttgtatggaaaatgattacattcacaacaaatgtgttttttgttttgttttttggcaatgcatattgtaaatttaattacgaatggcatgacacatggatgatatttaaacaaaccactatatcacatatgttgtcgctataaaaaatatttattattgggttaatcgatcccaggtcctagaattagttttgatctctttgctatatataagaacaatcggtatattataataagaatgcattgacctaaaaaatactattaataataatattaatgcaataatgaggcaaaacaattaatcacacatgattcacgaggataggaaaatggttccagagacaacttcacaaagagtgattattatggtatttattgtattttaattattaaaaaaaaaggaaattaacagcaaaatctatattgtaaactcactttacgtagaaaaacttcttcgatataatattatggctttgattggtaggttatgaggacgtggaaaacatagattaaaaggcaattctaaaaaagaccactaaaatgattttgttcggaaaataccatttagtatttttgattatttttttcaaaaatactactaaaagattttttcctaaataccacaaaactaaaactaaatataaaattttcagaattaaatcctaaatcctgaaaaataacctttaaaattaaaccctaatcccaaaatactaaattcaaacccaaaattttaaattttaaacccctaaaaatcatttttagtgtttgtgttattcttactaaccgcaatccgtctcataaccagttaagcatataggatattttacaaattcctatgcaatgtgaaatatagttgactatttgtattctggaatcttttatatcatggttgaatttttaaattaattagtaaaaaataattcttaaaagtgttttttggaaaaatattgattttgctaaagttttttggaacaatcatgaatctgcgctgctgtattaataacttaattagtaattctatacacaaactcaattatagatcttcgattcacaaagaagcacggaaattaagattgtgtatagaactaatcttaatttcataagtaactaatttataattaagttataatttattcacaatctcaattataaatttgactcaattataacttaaatatttcaccatttatttaatcacagttaattattattttttaatttgtccagacagattcaacgggagcctcgtattattgcataaacaagtaggagttatataaacatagtatttttcaacctctactggctttagaatataaatatccaattatcatctatatgataagcgtaaaatctattctacgtcacgaaggattggattttattggagttttcttataataaaactaatgattttggacattgataagcaaattcggatctgtagtgggaccaagttacttgcaataacacgtggggagttgagttcaaatctttatatgttgatcatttgatgtgttggcacgatcagtggttttgttttattttttgaacaagcatcatcagtgtttaaaatagtgaacatgataacttacttatatcattaggggtaaatattagctatcaactatcaagtacgagctaatcataaaatgatatatgaactttagacccataatatgatatcttcaagactacttaaaacctcaattttctgaaatatactatgcaaatacccaaaacacttaaactaacagagcatttacatatcctcttttgcatctgcatttttttttttttttctaattttgagcatcgaaagatcttcgaaaataactttttatgctcctaacgatcgattttgacaattttcttcgtggtctatttaaatactgcacaaactatcacaattttgtctaataaaaaaacttacaatatttatcattgttttcttccagtttatccatatgtcatatgctttatctacatttaatctaattcgtccacgtgatgggctgtggtttttttttttcttacctaaagtcatagactcacaaatctatatttctatcaagatggatacatttatggtacgaatcacatgattttgatctttaattaaagtcttgttagttttccaatgccagatctcatcgcatcggtggctactcaaatccccacctattaataccaatttcaaccaaaacaattcccacatttaattattttcaggacctttaatttactaaaatttattattgctaaacctaccggatcgggtaaacggatatgcgattcgtcagccaaattcatataacaattataaaccatatgctctttttccatgcagatattaattgtatactgcaaaataatgattataaaaaacaaaatcatatagatccactataaagagttcactcgaccacattcacataacaaaacaaaatcatacatactccagaacaaaggaaaatttaaaatatatctccttatatactcctaaagttttctttcctttagcttcttgtttagttttattctttcaacattaacttttttttactctcttgtcaaaagagaaaaagagttcttgta

SEQ ID NO: 500 - DNA, 3000 bp, Arabidopsis thaliana
gttgttctgctttcttaattgccgtagagaatgtgcacattctatcgaaagaaccgtgaaagtttgaggcttctaatgtaacattctattgattaaattaaagaccattaattgaccaaattgtgacttgtgagttgtgagtgacacaaaactgtaacattctatcgattaaccgaaaataaaattttatcattttgaaacctataactcggagagtggaaagtgaacacgccaacacaagacgtgtccatttagattgttggatataacttgtaaagctcgatatgcatgtatacgtatttatatgcgtaatatgcaatacacacatgcacatacgtagacatacatgaacgtagatgagcctatatatgtttgtttaatcgttaaatttttgaaagaattctgacttgggaatattatttcaatgaacttattccatggtacgaaccactacatacatatatgcatgaatgtgcattataacatgagaagatacatgcacacagtcacacatatatgatttttataagtatgctttcacgaattttgttgtctataactataattaagaaaatagctatgaattgagataacttttcaaaaagaatattttaacaagaaatcaaaaaatattttatgataatgagacgtaactcccgtaagcatttattatgatttattttattattagaaaactttattgtgaaaaaatgcaattatataaaaaaaatataatgaatagagagattttgtttcattaaaatgtgttcatgttagcaattaatggaaaagaggaaaacaatatttctgactacaaaatacagacctcgaaaccttaaatgtattagttaatgaatccaaatgaagaagtgtcaaacatccggacacaaaaattaagtttgcaaatattttaatgttattatttatcccaaaaagagtatatggtgaatgtggcacaatctaaagaaataccaaattttcagctacatataaaaataaaaaaaaagaagaataataactatctatttataaagaaaaagctccacgtcgtacgtgattagctcaaaagataagttatcatattgatagggaatttcattttaaaaagttattatcatattttgtaattattaatttacgagtatcgtctttgggataggatgtttgtgatcttgggggcatagaaaaaaacagtagaatttcgagagctctagcatcattgatgaatgtacctgctcgagtttataattttagaccattgtcaattatcatcgtgaaaagattattaaaacatgaatgtaatatttcattctcggattgtattaataaatatataatatgtttcattttatgagtaattttgtactatacataattcagttaatgatcaattgcggaaaattctaaatttttatataatgagaaacttatttacaattttaaaacttatttaacattcgtatatatgagttgaacaaatgcaccatgtgtgtgtgaacaaatttgcagtaccatgtaaaactaattagcttaccaagatggactacaagtgtttttggtcgggctagaagtaaatgggttggaaactggtcatagatatgggtaaacgaccagcggctgtgctcttttaaccatctcctaaattactttaatccaaagccaatattttttgatcattctcattaaaatggttggttttccagtgaattttgaagttaaggtatatctgtagatagtcaagtagctagattaatcattgggtaacacttaggtggtccgagaccattttgggtagctccaatgtacatctcttgaattccatcgatccaaagggtcgtttggtttcatcattctccttaaaatgatgtactctctgaaaagaaaaaaaataggttaacgtcgttaggtcgaatggatttttcaatgggtaagtaagtatttttgattttggtatggttcggataaattcacgtttatccggctaaatggctcgaacattttgaattccacccaaatggttaatcaacttcttaggaaaaccttttgagtgaatatccaagcctctatttaatcgatcagatctaggattggacaaggatatcctccttgtatttggtttttggtgggactaattaggtaactccttggtccatgtaaaatttttagaagccacaattgaaacgtaagaaaggcactaataatcacgggcatgccatcatcacccatatacagtataatatttatataagattttttacacatattaacaaaacacaaaaatctcatttaaattatttcctttctataaaaacattattaattacacctaatttaattaataaaaaatatgtaacaaaatataattgatcaaaaatattaaatatatttaatttttgtatagaaaaatgaaaacaacatttattttacaacaacaaaacaaatcattaaactacatgaaaacacaaaaataataaaattgctaaacaataaatgttatctaagaaaactataattgtatacaaaagctagctattacacttagcaccatataaataaacttcttatccatcaatgtttaatatatatttgtatagtaaaataaaactagtttgcatctgaaaaagtataatcaaataaaactctttagatagcaatatgtacattaaaaaaagacttattttcatacgtattaagctgtaaaaaataatgattaagatttggggtaaagagaaaccaaagtttaagacggaaacgaaacaaaagatgataatcatcgattcatcatcacgatataatatgggttgctaaccacaatagaaaaacaaaagttcttttaaggttttaataatatatcaccaaaaatgataattaaaacctaaaattaaaataatatatctacaagactacaacaattctgctttataataaagctataaacctcaacatttttcaacctcttcccaaaaaaaagtgtagaagcagaagaaacccatcatcatc

SEQ ID NO: 501 - DNA, 3000 bp, Arabidopsis thaliana
tccaaatttagcagcccactcgagaaaattaaataaaaaaggagagaaacacttgcttaatatagaagtttctttttggaagaaaataaaaatagtgaagccccctttttgagcttgttgacattataaaagccaaagctggaccacgattccccacttctatcaatgtaatctattttttcttaagaacataaaaagatttttaaataaattgatgggaatcgttttgttttttatatttatactactatcaaacagtataaaaaacaaaatgtacacaacaacattgagaaactaatggggtctcacgtgtccatgttcccatccacatagccacggacgggatttgctttctaattttccacatttctttaggccaaacctttataaatggcacttgatatttgcttctttaatttcaatctctttttttttttcttttttttttgggtgtttttcccgttgtatccattgcatttagaagaaaattgttgagaccactgattttcttcgaaaaagaacttcagcaatgaagagtttgttttatgcacgtctttacaaaaaaaaaaaaaactaagagattatgacctgcattgaagtgagagcacttgagaaaacttgtgtgtgatgatttggaaaatagttgttatagataactaatcatatattggtatatatggattcctttgaagaaatactggtttgatttgaacaaaaacatttgttacgtatgattaaacatacttttcattgcacggtgatacgaaattttgattcagttgaattagatcaatgtagttttgagttatattttttatgtttgcccattcgttagtgatataaaacaaagtatcatcagtatatagctagtttcgagatagtatgtacaacttttaaatattaattacctatgcttaaatagtaatagtattatgtatgtgcatgtgctttgtacatacaattttgtcttcttgttgattaattattaaacagctcgaagttttaagactatgtagcttagcctatgtcaatgtcatcaatctatatgcaatatatatagagcctcaggcacataaaccgtagtccccatataaaaaagggaatgaaacagctaataactccatagagaataaattcacattcaaagcaaattcaccaccccaatcttctcaatggttcggtttcttttttcaattcttacattgtactaaaagctaaaaattcagactgatacgatacgaataggtttttgaaaatataaaaattaatcaatttccattaaagggctgaatagctaaaaactccatagagaacaagtcgctttattggatttagattttaaaaagacggcgctcgtgaattattaaagtttaaactaagataagatttaaagagatttagaggagacgtaatctggtgtatatcgttcacatagagtcacgtcactgtataatccatcgaccactaaggttttagagtttagtttcaaatcttactttttcatgcaggtgtaccgtatgtcacacagattatagtagtcgccaacttacgttcccaatgggtgataacggcgtcaacgtcctccgtcacgatcgtgtcgtaagctgtacactgtataggttccgtgaaccttaaaatcggatttggaaagctacgtacgtacgtaaatattggttaaaaagttcaaacagttttgatctctcttttattacaaacaaactgtacttccgacaattttctttctttctatttcaagtacgttttcgtgtctaactatattaacatctaacttctgacttttatactctgatgggacaatctttaattcttaaattctaagttgtaccatgcgaatggatattagattttgtcagtacaattgctgactatgaatgaagtactctaacatcattattggttcctgaataatgagtacttaaacaaaacaaatttgaagtaacgtaaccatgacatattagatccatgtcccctaaaacgtattaaaattatttccttacgtcgttaaatttcgaatctagtgttaaattgttacattggttgttaaactaccgacccaataaaaaaaaagaaactaatatttatgattggtgcatcttgttgtaaattgtaatcgtatggcctaccagcgatttcattgtccccaacatacagatatttttgttcgtgtgttataaattagggtagaaacatcacatattttacagagacaaagaaaaaaacaagaatcgtaataaaatgatattatggatacatgtagattataagatgagaaataataatttgtcacgggtccatcagtatactcgtcaaaattgattaggtaggtaatttacttcacatgctcttcctgtatacaagtataaagtatgtattttcatctaaaatctactcttttctcaattacattttatatagaaaaattcatattcttaagaaatagtagtaaaattgttcttgaaaaaaaatatgaaaaggcattttccgtgactcagcctcacaggcggcttaaaacgacgtctttttcaattttaataaatttttggtaaaaaagcttttggatccgccgctatcttcagcaattaaagttggacgcagaaactcagaagcaaaaagacgataaatattcatcatcaccttcatctctctcttcctctcatcagacttcaccgttcttctttctctcttcttcatcttcagacgaaacctcctttacttccccttcaaggttttatatttcccaaatcctacacctgctcacatctcaagctcaagttttgttttcccgggaaaagtgacacaaacaagaacttaacaagggagaagaaaaagcttatattcatatcaacggttgacgttggaaagctattaagatttggttttctacaaatttgttcttcctgaaacgtcacgagacagagcttacaagaagagaaaacagaggaaatttcgttgcattttttttacatattgattcgatta

SEQ ID NO: 502 - DNA, 3000 bp, Arabidopsis thaliana
atccaaacaatcttttgatgaaaataaaaatgttatagttgacgatagaaacgagcaatgcttcatataacgtggaacaattgcattacatagacaattgcttgtggacattcgtactctacataaaattagtcgaagttagcaaaattcacctaagatattgaatcgtttgtgatacattgcttcttccttttgggggtttgatattaaatgcttttacaactatatttccattgacaatctacctttataatgattattagctaaaccaacttacaaacaacgttttgacaaccataattgttatgcacttttcaatagtcttaactctgcttacggatgtcgtttgctcagcaatttgggaaatgggaataactcatataaagagatatgtgtgttgttgtgtggatcccatgcatgtcaggtttgtaacagctgtcgaataatgcaagctacatagaaaaataaaacattttcattaaaacacaaaaagaagaaggttagagagagctattcatttattcatcgaaacattttaatatgggaagaagggaattcccacaccactccactacgaagagaggcttcttgggccagtgtcacgtgattaacacgcggatccagacccactcatatataaacgaattatctataatattttctaaacatatttctttattcatcgcacatttttttttttcatgcttcacgtatacatccgaaaaatctttgtggtctcgcccatatctatccttttaaatccatcatgatcccaatgtgatacgttaataagaccatctgcaatggttgtctctattttttttttgtaaatatagaagagaaaatagagatttctatttttactccaataattcttcaaaaatagaaatctctatttgttagaaagaaaaataggggaaaaaaatagagatccatatttttgtttctatatatagagaaaaaaatagagatctctataatggaagtgagaatagagatgagttggagtgtaataaaagcaaaaatagagtgtagagacaaaaatagagatgtgttggagatgccgtaagtattgtgaagataatcctcacagctttctcagcaataaaagaaaatatatctctttaattttttataaaggttttatgtgtgaatattaaaaactttagtctcatatgagttcgagactgtgctcgggaacaaattttataaagataaatcatctaaaattgaactgcgtttataatggcaaagactttgcataattagaatgtttcttattgataaagactttgcatgtttcatactcattttgacatctaattgaataaaaacagaaaagagccgtatagcttcaaaatctttatatttagaataaagtgtatatatgtgaaagagtaacacatatgtacgtaggaattaggttggttaaagaattggccacatcaatatctgagacaccaaagaagtaatggacgttgggagagtaagtaacgttgccaaattggaaatgccaaaaaaagattgtacctttcctctctttgattgagactttactactacaccaaaccttacatcaccaatcgctgaaagtgaaaccgatattttagcacatttatattccacttctacacctttttactaaatttcagttttgagatttacttacatgaagaagaaattggctaatcaaaataatcaagcaacgatgatttgttgcaatgaaatggaaattgggatttgggctcagattattagagcataagtggatttcctgttcggcccattgtgtgaaacaggttattccactggacccatctgttcatctttgtcctcaaattttcctctctatccccaaaacacccttttaaagaagtaacattaattgtttttttttttccttttaataaatttataagatattttgaattaatattattagtacgtctcaatttttattttatttttgccttttatactctaaagtttttaatacttgatgaattttgaatatttttaaaaaataaaaaaaataaaatatttttaaaaaattaatattacgcttggtagatttcatccaacggctgagataattactaaaatggtgttttgagctcaattatttttccatattaaaaagtgtttttggttcttggttatttacaggtcaacaaaataatttgacaccggaatcggagtccgtggaaagtcagaaaacctgatgtaacaccatttatggcattaactactgataataatactatacgaaaatccaattattataccgagaaaaaaagaaaagtggtcagagacagcaggctggtcctgctgaagaataaatctaatctaccgattcgattaaataaatatgtgccgttttctggtacgccctattcaaatcatttttatattatagtatcaaaatacttcaaaaatttactaattacaaaattaaggagtgataaaaaaagtttataatcagagataaaaagtcaccggttaaagcccaaaaggcccaagtaatatccattgggatccagcaaaatatataacaaaagaaccgtaccgtacctacaataaccaaaattggttttctctttcttttgtctaacagtggcctttatttaacagacgcactccactgctaacgttgctttcgtcctactcttcttctggtgtaaaagcttttcttccacacacatttgagaaagaagacgaagaagaagagagaataactattccttcttcgccaagttctctgagctatagaagaaggagggatttcttcagaccgccattgttgcccaccttctctcctttctatttttcgccgcattttactcgcttactgacaaaagtcttctactcaagtctctctctcgctctctttggaggctcaattagggttttgttgtcgtgagatttgattacacaaattgctgaatttggtttcgattattggtgttattgttttcgaagatttccagtgagtttccgttt

SEQ ID NO: 503 - DNA, 3000 bp, Arabidopsis thaliana
aattgtttgagtaggtgtccttgatgttattcttgatgaatatccaagtcttatggacgagcaagatgaagatggtaggacttgtctttcatacggagcatccattgggtattataaaggactatgcaacatcttaaaccgatcaacaaagggtgtttatgtctgcgaccaagatggttcttttccaattcattcggctgcaaaaaacgaacattacgaaattattaaagagtttataaaacgttgtccagcttcaaaataccttcttaacagacttggtcagaacattctccacgtggcggcaaaaaatgaggcctctcttactgcatatatgttgatgcatgataaagatacgaaacatctgggtgttgggcaagatgtggacgggaatacacctttgcaccttgccgtcatgaactgggactttgactccattacttgtcttgctagccgtaaccacgagatactgaaattacgaaacaaaagcggcttaagagctagggatattgccgagtcagaggtgaaacccaactacatctttcatgaggtatttctgattccgtttcatacaacacatttgatccctcataaatgatttatagcttgacctccatatttttggaattacagaggtggacactggcgctcttattatacgctattcactcaagtggtttcgaatctgttaagtcattaacaatacagtcagtgccactagaccctaagaaaaacagacattacgtcaacgctcttctcgtggtagcggctcttgtagccacagtgacgtttgctgcaggctttacaataccaggtggttatatcagcgatagcaaaaaaccaaacttgggcagggcaactttggccactaacccaactctcttcatttttctgctttttgacatcttggcaatgcaaagttctgttgcaacaatatgtactcttatttgggcgcagttgggtgatctagcactcatcctcaaatccttacatgtggccttgcccttactacttttttcattactatgcatgcccgtagcattcctttttggcgtgatcactgcaattgcccatgtgaaatggcttttagtcaccattagcattatatctggtggattcttccttttcgcaatctttatccttggccctcacgtcatgctacagcgctcacaccttccgcccagttctggtatatttctcaagacttttatgctgactatagacatatctgagttgtttgtgattttgatcaaagcttgttttggttgtgtggcgtgttccgaataaatcatcaaaagtttatagatcaaaggatatttttcttctcttttttttttctttcaaaaagctacgagatatgctggtctctagctctgagaagcggcatcttgatcatacaactcattcgaagtcctatcagaattatctgtagttgtaataaagcgtgaaaagtatatcattcgaagagattttcctctaaaataatcgagtgatattttattattcggtttagtggataccagtttactaatctctcgaatttatgaaccacattcaaaggagatgagtttaacaaaaaaaaaaggtaaattgttttttattctcgtcgtgcgttccacatgagtcgttttcaagagcaatatagacgatacttcacaagaattattatttttgttggggtataaaaatttgaagatacgtttggcaacgacaatacgacgttagattgttccaagaggtgcaaaaacttagggaccctctttattcgttcactgtaaccactgaccacaacatgactaggtagactcttctttttgtcaatgttgatgtttatacgattttgatgagactggctctatcaagatatgaatctctgatcatatctccactaatctttcatcttgttattccctcatttacttttgatttccttctctctctctcttttttatgtatacaaatttttctttatttcgcttcactaaaccccaccatgtaattgtgtgagttttggcgaagtggcgcaacaccgtagagcacaccaacactaacccaatccattttatgaccgtaaattttgttgttgattagtgtatttttttcttgtttagttattctgagaagtaaattttttttttacaattagtttttaaacatagtaaaataaatttatgacagattataatattattttaaaaatcaataatatctaacaaattaaataaacaaatcacaaattactatattttaaataaatattgataattttaattatattattttgtttattggttaactcgcaggatatgcgagttaattcatttgagattgtaatccgccatatactaactcgataaccctgactttttagaaatctaaaagtataaccctataataaaatagattatgtccaactcgcggattctaaacctgaattgacatggcggaaccattcataaaaccataccaattcttgcgttttggaaagttggtttccttttcatttctttgaatttgatcctagattgtgtagttctcaagctcatgctcttgctcgtcaaaaacgtatcaacgatttgcttttcctttagacgttcttgcatcggattggtttactcaactccactcgatgaaaaagttactatcttaaaaagaacaaatgcaaattcaataaaattccccaatatctacgcatgaaaatatgattctgtcttttttttgtttgtctatctttcaatactttaaaaagtgtatttctagaggcgatttgtcatttcccgaataggaatttgagtaaaaaaaaacactctgttttttatttccactaatatcaaatcggcgaatatagttcccaccattcttatctccttgtcgtcactcggaattttttaaataataggatcgctttaataatataatctctataatttatagttccttttccaatattggcgtctccgttgaagctttccacaaatctcaaatttgtttggagactctcaa

SEQ ID NO: 504 - DNA, 3000 bp, Arabidopsis thaliana
ccatgttgcttaaaaaacacctgagctcgattgttccctccaaacatcattgttcttagctgctcaggactccacgagtctaagttcgttgacctgcacaaaaacaatatgatcttataatagatctacaacaacatgaaatgctataaatagagtggtcaacaggaaaaaataagtcaacatcttcctaatcacagcttaaaccctagccagaaggtgaaacattgctacaagtccatgaagctaaaaattaagcctaaagagttcaaatttgtgttcctcaagattcaaagttttacctgacgaagctgatatgaacacctagacttcgatgaacagcagaacaatcgatgcataggaagatcccataaggaacagaagcccatgttggattcttcgcactacaatcaaagcaaacctaaaaaccgaagcaaaatcataaatcaattcggaagatttaggtcgtataagctccagatctgaacgaaattcaaaatcgaaaattgagtaaccctaaccttgttctcggattttgatttcagctttctgaaaacaacattcttatcggtgagattctcagtcgccatcgttgaagagtttagagatgtttccccagaatctggaaatctgaaagtggcgattatggatcgactcttcttcttcaaagcagaaatttttgtttttgtttttctgttatcttatttgtttacgttttttgattagaggatcaatactaaactcgatgggcttgtatggcccaataatgaataagcccatatttgtatttcgtaatttcgtagatgtcattatttttatatgaaagtcacacaattctaaatcaaatgtaaactctaaccatagtctaaatcctgtaaaaaacttctaattctttaatcacaaaacttaaccataaaacagaaaatgaaaaaggataaaacctcatcgctaaattttatcatgattttctccatcttgttattagcgcaaagaggatcgcttgaaagatgaagacagaattgtgaaaaattgaaaaccaaaataattgttaaatccaaaaaatcgacttgttatggaagtacattaaggtattaaattaggttatcttcactaattcctctcgaaccttttactttctttcttttttgataaagtaaaactttttacttgatacaatgtttctgtgacatgtaacatgtttatcaatgtcttgtaagaaaactggcaagaagtagagatattttattatgtaatgtcaataatcatatgttagtgtacgattagtgggtctaaagtcgttttgtaattacatcatccacgagaatcacgtgagctggatcattttagccatcgtgattaaccattgaatattattgtacatgttgtccttttcactgactacttttcttcttctttctttttttttctggatattttgtttataagtaatggttggcattatcatgtgtagttctttgtcaataatcatgtgtaactttgacaaaaaaatcatatgtaacgttttaaaaaattatatactttggttggtcattatagttttagccaaacgataaaaaatttgatgaaaaaaatgtggttaaagaaaacttacagtataccgtgacaaaaatatgaagattgttaataaatagatatgtcaattatggtgacagaaacatggaaagcagacagacgatgcctagacagaggacccaaacaattaaagtgggctacacaacataattccaatatttaaaaaaagaaaaaaacaatttaaaatgtctaagaaaaaataaattcgaatatgaattttatagagaaaatacaaattttatacgttaatttcttcctctttcaaaaattgaacggaagttgctatgttgttggatacattattatttgaatatatattacaaataatttttaggactagcaaatcattttttgagttttctttttatggttttcgtagtcaactccacaaccgatagttttacatcgatgcttgtacaattttacagtttgacagatggtactgtactacgacatacggttctatgcaccacactaaaatctctagatagaaatcgtttccattaatcttcaataatttgtaatctatgaaaatcaaacttcatatatggtgtgatgaagtattaatggatatttagttaaccattacaccaaaaaaaaatttacaccggataattatttgaaaacgtaaatttcatattaacggttcaaactgatttttaataaaatgaacataatgaaatgatatttaaaaaaaaaagatgattggagaaagaaaacacttttagttttttcatatatatttattttcctataactaacataaaatcagttgaaatattattttaaattcctaacttaattgatataaattgagtagaatctatttttttccttttaaaaatgcaattcttttttgcagtttaaaatattaatttatatgaaaaataaaatttatattttagatttctaacttatgaaattttgaattatagcattggtccatattcgaaactctaagtcactatatcaccataaatggattatttattagttttttctccataaaacaataagtggctatgtgataataaacggatctaagttatgtttcagacaaaacagtgtccaaacgagaattatcactccatgaataatttatttacgttttcgtaacagttaaccaaattattatcgtttggtttttgtcatataatatgtcgcaactctcaacaaaaacttaagaaaataagaaaaaattatttacaattgttttagaaaaacaataaaaataaaatatagtattgtagagagaatcatcttctccaaacaatcactaaacgccatttgcttagctttttccctcttttgatttttcctccctacacgtcacctctctcttcttctcaccggaaaaaagtcttcacctttcaccggaaaatatcaccttttcaaccggcgtatgttcac

SEQ ID NO: 505 - DNA, 3000 bp, Arabidopsis thaliana
ttttaacctaatctacacatcattaggttatccgtgaataaacaataggaattttgaaaaatatgatactgcttttcaaaactactattaagagaaaagcttttcaaaaaaatcactttatagtctgtatataagactttacaaaccttgtaaaaccatataaaaacttataataatctaattacattttgacgtaatatctttgagttcctttaaatataataaggaacactgaaattgatataacataggattaagataaaacgtttcatgttgaatttggtattagtgtagaagaaagcgatgtcacatattggaacatagctagtgccagtttgcacaggtactattaaatcttcggagattttgcatagattcgtaaattgaatagataaaaaacaaaaggagagtcgtaccatcacaaaactcatcaatttttaattagaatttttttctctttgttactattttattgcattgtaggcgatgatatgtgagtaaaaggttatctctcgtatcatgcggatagagacttctatgaatatctatttcgtagacgtaaccgtacgttaattagtctattgccaggttgatttatttgtattcttcttagtagagaaaatcaatacttcactaaacaaaatggaaataatatggtagaaggacataaaactgttttgataatagagaagaaaacatatagagatgcaacatatttgaataacaaatataatgagattaagctaaataaacgaagtgattaatagagatctataacagttatgagatcaacctaacttacttcatatatcttacaatcgtcacataattcactagacttatcggccagaaaacgccgtaaaatggaagttgtttctttgcatttgtaagtaatgttttgggatataggatggtagaagaaaactttgagtcaatttcttagagtgaagtaatgtacctaatctatctcgtaattcaagattcattttcatatcatcctttcgtaattagtctcgtgcacttattcttttctttaaatgtgatcttgaatattcaaaacacagtacaaataatagatcagccgctaattaaatgcgttagataaagaataaaggttttgtgcaagtaccctgatttgaaaagaagcaaaagagagatattggtgaagaaaatatgatgccaataaatgtttattcctcatccggatgaaacgtgcataatctctatcatcttcgggttatgataattaattacaagctcatgcggacctttgacatgtaaattatgtccaaaagaacaatcataatgttttcttggttcctaattagcatgttttctttctgctctaaacttgatctcaaaaagaaaatcataatagaaagtccatagatcgtattcgtacgtatacaattgataattaattaatcgtagattcgcttaatgtttttgttaagtacgtgtcataataataatttataaatagaagaaaggaattataatagtctaaataattaaggacatggattgtgataaattttgatggtcaagtactcgttttttcgattattactataagagtacccgattatatcaaaacaaaatggagatttatgattttttgtcttctatgcatacccaacggtatcatgggattggacttcacaccttattcacaattttttttcttttgtccttttctgaaaaggaaatttcctatgtcgatccaaagtgggaaatggacaaaagtttttattttctctaacaaaaatggacaaaagtttgtagtattatggtatccacatagagattattattgagaagatcacgcggcattacatatttagttctaaatgtacagtattttggatagggtaatatatctctctactatctagtctttaattatatctgactcgttaaactgtgcctatatattgatctatatattagctgtggcaaaggttctgcaatctgataaagtaaaattgattgataaatgataaatattgctcttttggtgtacattaacttttttgatatgtgtattataggtccgaccctcttataaagtaaaacaagccatagctttagggcatttctaaatatagttcgttgttagggcgacaatattgaatgcttacgtgagtgtagttgatggtcaatacaaatacatcaattggttttagagaacattttcctcgagttcgactgcccacgttggtcgttctttcgttcatttaatgggtttagttgattacttctttttatagtacatttattgttttcacgttatgcgctattatattcttataaaaaaagtcttaattaaatgatatattgatcagtatttgtcttgtttagttttacaacatggttgtattacaaattatgtagtatttataatcttatatttcaaaacataatttattctctaaataacataaaactatggagaatacaaattacaacaaaatttaaaattataagttcttacataaagtaatttgaaacaaattttctaaaatatcatgatacccatagagtaataaaactaaacaaaataaatagacaaatattccatgagtttgcatttgaaaaaaaaaaaaaaagagaacatacgtatctaagaatgatgaaagatcattagtcacctaatttttgaaattcaacattatttacttaaattttcatttttactcttccatggttactcaatgcaattacttaaatatacaatctcgatattatatataaacatatcatctaacataaattacccgccgaaatatggtagtaatttcttctcaaataaaaaggtatcttcaatatacaagtggtccctaaaatactctttcttctgtttctccttgtttctttgaatagtgaatacaaaagcaattccttatataaaccacttcaagtccttaatcttctctcacaaagaaaaaacactatctctatcgacaaagataagagaactcagaagcttctactcttaaa

SEQ ID NO: 506 - DNA, 3000 bp, Arabidopsis thaliana
actggaaatggctcttaggcttcttgaagaggttgcaacattttcagccacgttggttgactacagtagcacatataactcactgattgaaagcctttgccttgctaataaagtggaaacggcttttcagttgttctcagaaatgacaaagaaaggtgtcattccggagatgcaatcattctgtagtctaatcaagggacttttccgaaacagcaagatcagtgaagcactattgcttctagatttcatatctcatatggtttgtcctctctgactctttcttctaagtttgaaaactgcagtagtcgttaatgtttgtcaagctttatttctttgcgatgttcacttgaatctatgtgtatttgactagagctaattatctagtggaagaaaaggcatttaccgtggtagtttatattgtttatttgttctctccatcattgtgagcagtgataatgcagattggtactttttctggtattcattacttaattgtctcaattttgcaggaaattcagtggatagaagaaaagaaaacatctgatgggacttaggcatattggtttatgatgtctagttctgatattctcagctagttggtgcatctgatgttgagcatcctagtcaaaccctgaaaattcgaaggttggaagctatggataatgcatgaggcgtgtaggatttttggaccaaaattctttgtaagttcattggttttagatcacatagtcagaaatcatgtcttttccggtttttcctatgaatatgtttatgtatgcaggttctgctttgtacatgatgtgtaaaattatacttgtaatgactctcaacagagttgaatggcctcctttgaacactctatgcatcagatatgcagagctcagcttctctctcagatcacagtatttgcttcttctggggtgactcagtttcccactctttagtagtccaaacatttttagatgctgtgttttctgtttataagaacctttacttcactggtcaattctcagctaatatatgaaagataaattcatacttgttttgtaatcgatacatgatatgttctttactgttgcacctttccatattgatgatgatgttagggatgttgtatcttgaaaagaacgtatttgcatagatgagtagtagtatgcaatcgatgcatgctttgtattgaaagtttattactctattgctaatccaggcataacgtgttacagttcctgcggaatgagcttggatgaacacggacacacaggaaagggaccaagaagatctcaaagcattaacaaagtatctctgtccgaagacacaaggtaaggcactcatcgttttgttggatttttacctgagaagacagtccatatagatgtaggtggttacatgacgatagttttgcaggtaaaatatggtgacaaaaccatcaaaagcttttgtgcaaaatggaggagttctatctaacgagaagctgggtttttttgcttgaaacagtttggttgctatcacacttagcatgacaacacactacctaatgaatgaagaaggcccaataaggtgtcagatatgatatgcataaagccagtgtttgtgtataatacgggacaagggccctttactgtacatatagatttattttggtttaccctacagtctacagatcaatgtatactttattttgttttttgttattaaataagatgagagatcttcccctctgttaatatgtctggcttgttttggattttatgttaatgcactggctttctgacattggaacactatctattatggaagatcattttaaaggattaatctatctatgtatgtatgtcgtttagggaaagaaaacaatattggcaaaagataacaatagctaaaacttgtaaagaaattcaacttttccttttttcattagtatagaaaatcccaacttggtaaaagaagacttgagagtcaaatgttgttactataaaacaaatatgaccaccattgaccggaaaacgagaagattttttcgtaattcgttgttaatttctctcgttggtcagatatatttcgatatctattattattatttggtgattttttcatatctggaaattgagtaagtaacgatttttttttttaaaaaaaaaaaagagagagagagagattaggaaacaagaaagcagaaagagaggagtgattagagagagagagagatcaataaccaaagaagaaggaagggaaggggattagattacaaaaacgccaaagctgttaactttttctttttggccatttcctatttctcccttcgtctccatcaagcaaccctctctctctctctctctctatcatcatcatcgcagaggagacgatcttacgcgacgaatccttgagagattgagagggacaagcgagttttgtaggtgtctcagaccggttatttttttctcttttcttctttttatctgaatgattttggatttcgtagacaattgtgtggtctctagattcatgctttctaggcctttttaacgcatctttgctttcttagatttcatgttttacaattcgatttcgtttctgattttcttttcatctgggttttgtttctgatttgtaaatgttcattcttttgtggattgtgatccttgagtattgttttcttctggccgtatttgctggcaatatgaggttgtcgtccctttttttgctttttggtttttgcatgtattattatccatcttctgcccataaacaatgttctcaatgtagttggatcttgtctttttttttctgagaattttgattttatgaaacttgtaattacattttttttttctcaatcaaattgctatcaagatgtaattacattgctgaaactgtgtatagtagaagacatgtttttggctcacacatctggtcctatctcttttgcatctaaattcagttacttgatctatttcaggacccaaggattgttgacggtctatattgaacaagtaaacaagg

SEQ ID NO: 507 - DNA, 3000 bp, Arabidopsis thaliana
tcgagagaaaataatcaacgagctaaaataagattgatcgatttcgaccctaacgagttttacttacaaggtctcttgaagaatgccttggtatatgtaagctgcccagatcccagcgacacagaacgacaataacagaactcgccggagaccggaaccgtgagattccatcgccgcacgtcgcttattgttttatccgacggagctccggcgaaaatttgaatttcaattttacgctatttgatcagttttgcgatcaaattatgagatcggtctgaagtggaaacgaaagttattagagagagtgtaggaggcgcgagaaagacgtagattttccacgtgtaactgtgtcattggcttaataatctgacatgacacttctgattggctataggacgtggatttatttctggaatccaagtcatatgcacattcatgtctgagataggaatgggaactatgtgccgttttattgtcatgaaaacgtcacgcagtttcctagaacttgtaaacggatgttctttttacagcttgggccttaatttgattaagcaaacttgcacacagctaatcatgtcagtttgactaactgatgaattcatacaaatctaagatcacttgtggtaagaaaatgaaagaaaaaggcgtatatacacaaatggaggaaagttgccaacatgatttaattgattaaaatttagtgatgacccattgttaagattactaaaacaaaatatgatatatcttaaagtaaatgtgacaataacgtcaacatagcgagaaaagtttgaaatatcgaatttccattatattaaaacaaggtatcacatgcatgcactcatgcatagttcattatgatttgagtaattttctatacgaataatattatactatatctcaatgaaaatagaagttatatatattgggaaacggaatttatatgacatacttaatcctcatgggagaaccaattatacattttgaagagtcaaaagtcaaaactcaaaagagtgactcttaccggatacaaaatgaaaatagaagtcttggtgagataacaaattaatgtgtaacataacaatataatatcataaaagattccaaatggggcttttgtccacacgtgatatgcaatatgcaaaagaaaaaagaactctctttcgatctgccggtcaataacaatgtgaatatagattaactgattaataagtagtttcttgggtcaatgcatgggatattatatttaagaaatacaccaaaaatgtattcgacgttagccaccacgttccattaaaaattcaaatctaaatgatgattaccgtcgtctacatctatgattacaaattttttgtctactatgcgtttagttatttaccatggtttgacgattatatatataacacacataaattatgacggtttaacgttgtctcttaactcaaaacttaattttacaaaaatattatttaagagttgaatctcatactttaattattcatttggtcaactagaatgcgaaaaatccacaatacttcgtaactaatttcgggtcctttaaatcttgatcacctgttgatcaacaaaagatctacacataaagattgattcatccattgactaaacttttatttatcgaagaaagactatatatatctaatgcatgcatgccatatgcacaataatctaatagtaaatccaatacgtctcagaaagataaaatcgtccataataccaaattttattctaaggttttgatatctctcataatttggaagtgtatgtaaaagtttcttaaacataaatataacatccaaagaaaagttgtaaacacttaacatcttgattgaaggggaatctcgctaataattgtgactgaacgatagtaagtattattgtaaaatatcgatcaaaatttcaacgatatgggcgatccagacccaccactttgttgtcccttagcagacgtcaaccatgaccataattagttaaaaaaaacaccaaacaaaaaccacaacttccttttaattctttttaaattctaaatttcagactaacaaaaagtattcataagctgtttcatgtatgaatttaatatcatgaatactaataacttgagccattaactttaaccaaaaaaaaaaacttgaacaatctaatataattccctgtaacatttaaaagatggagatgggaaaacaagaattctaaagaaacattgtaaaaatgaaacagagacaaatattttcaagcaagtcttgtttcatttcatttctgtttgaaaaatgacaagtttaaagtcatgtctcatatgtgtaatattattaactttaaaatataacaaaataaatatctttgattactttttgaaatgttttttatctcaagaatttggaaattttcgttgattgatacattataaaatctgaaaattagatgtgaaacacgactttttgtccaccaccaatcctcctagaaattatcagtttatcactcgattactgaatgaatgaatgagttatctctgaaaagttgtcgtaccatttattatcccacgcggatttactgccgtgagcatgacgttaccgtatctatctcaaattactaaaattgtcctttccgatggccgtctaaaggaactaactcgagggcattttgtcattttgagaaattgttatgagtttgagtacaaaacaaaaggacacgacgactttgtattatttgcttcaaatcctctgttcttcaccttccttgttccttcttctctccttcttttttatatagattttcctttcatgttgtaatacttttattctattagcgttcatattcagctaaacagacattgcgccgccgttaagtcgaaaggatagaaagaaattaaagaaagaagaagcttgttgtctttgcttcttgaggctctcttcttgtcttgatcatctgttacgttgttccacgaaaagaacagtagctttgtctctccatatagggttattatctgaa

SEQ ID NO: 508 - DNA, 3000 bp, Arabidopsis thaliana
  misc_feature (49)..(49): n is a, c, g, or t
ttaattatacatcccattttcagaatcaaatttactatttacaaaatcntgaggcacaaaattatttcctaatgaaataatcccatatattaataccttgtatttaatggtaacgccatttctttcttagaaaaaggttttggcgaattatctatttttaatctataattactactgctaattggacatgtaccatgagactaaaaatacacacaaaaaaaactttaattatttgtttcctccctatacacagatatatgttttatttttcttctaacacatgcacaagagcacatcaacttttaattttatttattttaaattgttccatccacaaactatattgatgatggttctttgactgacgcattacgcgtgaaatggtttccttgcttatattattgtagtcgtgttcatattattttaatgatgctcatatgatttgtttgcatcctgaaaaatcttaacacgtttgttttctatgttattatttttcctggccagcttttcgtatgttgttcatttacaagaatactacatactgtatacacgtactcaatctacctcttttggatatattttttgtggtacgccattctacacttccgaatcaataataataaaaattaatctccacaaatgatttcttcacaaattggagttaattatatggagatagatatccctctctttacaaattgacaattttaccttcatgcactctaaatatataggcactcttcctgggagagttacaaagtaaatcctaaatcgaatggattaaacaaaaacaaaaaagatcaaaattataaaaacctgattcttttcaaatttgtgtccaattaagtgtttatttaaaccataattcctatttcttttatacaagataaattatcgtaagattactgatctgcttttttctctttgcctctgcttgataatttcaatgagtttagggttttgttatcaaagttttcgtttatttttgaaattagttagaggttctttccaaagatcattaatttacaaggtttataccggacaatgcctccccgactaatagatttacctgcactatatacacacgacaaacatttttaattggacacataatcacacaaaaaaattactagatgaaaaaattaaacacttaatcaactattagactacaatttttactttttctatgaccatttaatattctaatttcactcatttgttgattttaaaactatatcttcataaaaaatggactatatatcttgtttgatgaaatatgttgtttatatataaaagtttcaaaaactaactaatttgtgagctagggtgaaggacatggtactccaaagattgtacaatttctttgtgttcttgaaaaggttattacataacgataaatatagctagaaagatattcaactaaaaattggaatataagagaaaacataaagataatagaaaatgattggtgaatgaagaattatgcagggttctacaagaagaaaacaaaaaaaaaaggcataatgaagtaaaagtgtttgaatctttagagtagtaaaaataatctcaatttgcaaacgtttggaataataacttttctggaaaatctccaagttagtaataaaattgtttgaatcttgtgttggtgtttgtagaattatcatcaaaatcaagctgcttgaaccttaggggttactccttcacttcgttttattggttactgtctccatttgcattgcgatgttttcttctcgtttttactactattactacggtttatgacgcgcctgaactcatcttcaccatctcctatagtaccatttatgaattcaagtgataatcgatgactcaagttttcaatggtgaatcaatttttttttgagatctttctcttgagtatctttctattcacatcaaaatccactatttaatacgccaacatcacgtctaatgaacttgacaattatttctttattttgttttgtttgtatgtaaccaaaatattcagttttggattttgacacaataatttaccaaaaaatgccgtgaaaaagaattctaaaaacagattaatagtttttaacacaaaaagagctatttacttttatttaattggacatttatccatctttcatttttttaaattttatataaagaaaatacatggatatcaatcataaaatcatcaaccaagattgaaaatggtaattatcatttagttttatagaaaattatatctgtgtaagcaaccctgaatattaattgagtttacatgataaaaaatatagcttttgaacaattattttaacaacagtaaatattaatttgctatcttaaattatagtataaaagtgaaattaattatttaaaactataatctaaacatatttataatccaaccgtatagagacttgttgaaaagtaaaataaagttttcaaatgaagaaaatacagaggataattgtaggggccttgattgttttctctttatttggtggtctcatgtaaattatttttctttatagttgactttgacctttaaaacctctataattctctctttccttattcttcctcaaatctttgcaccaccattcttttatgactcagtcttctctctctcttctctcaatgcccatgataacaccaaaccacttgcttctgcttctcacaccacaaaattctctattcaataaataaatctctcagaagaaatttcttcgaattggagaagataaaaaaagttttatcttttcttgattttttttcttttttttctaatcattcacacccaatttaaacgagacttgtccaatctctatccatcaatattgtatcatttcttgtaaagtactctgttttagcttcacacgccattttttgtttttccatttgacttctgtaaaatcctgacaaagaattgtttaagacatacatatacgtgttatatatttgtaaaggaagcaaaaagtgtttggcttttaatttctctctgttggg

SEQ ID NO: 509 - DNA, 3000 bp, Arabidopsis thaliana
tctctcctttttattataaatacataaaatgcaaattatgaatttaattaaaaataaaataaaaatggatatatttttaatatttggtcaaaaagaaagaaagaaaatgttaagcaaaggggaagacgaaattacgccgaaaggtcctgagagagagagagagagagtggtcaaatgttgaaaaaagatgtgcctctcgtgacgataaagaagattaattacggaacctatatgcatttttattttatatactattaagttaaccattattggaagagaattactaagtgtggcaagacaaaacaaatttggaattttatgacatcaagtccttgtatcgaaatatcttgatttttgctttgcagttgcattacaagctggactctacttatatctagaatgggttttgctagcttaggaaatatattgcagttttgatttaggaaagaaaataaagattcaaaatcgataaaaacacaacatatcatatagtactttaaatcttcaacctacaaaaacatcacatccgttaaatccttacaatcattaacatcgacttgaacttctcacaaaatgtttccactgagaaacggtcttggcgagtgatggtatatttattggttgggcttaaatatatttcagatgcaaaaccatattgaatcaataaattataaatacatagcttccctaaccacttaaaccaccagctacaaaaccaataaacccgatcaatcattatgttttcataggatttcctgaacatacattaaattatttttcattttcttggtgctcttttctgtcttattcacgttttaatggacataatcggtttcatattgtaaatctctttaacctaacgaacaatttaatgaccctagtaataggataagaaggtcgtgaaaaatgaacgagaaaaaacccaccaaaacactatataagaaagaccgaaaaagtaaaaagggtgagccataaaccaaaaaccttaccagatgttgtcaaagaacaaaaatcatcatccatgattaacctacgcttcactactaagacaaggcgattgtgtcccggttgaaaaggttgtaaaacagtttgaggatgctacaaaagtggatgttaagtatgaagcggctaaggttttggatttggtctaggagcacattggttaagcaatatcttcggtggagattgagtttttagagatagtagatactaattcatctatggagacatgcaaattcatcaaaatgcttggatgaattagaaaaactaggtggagaatacagtaaaaaaattcaaaaagtgcatattgtttggacaacattaatatgtacaaatagtttacatttaaatgtattattttactaattaagtacatataaagttgctaaactaaactaatataatttttgcataagtaaatttatcgttaaaagttttctttctagccactaaacaacaatacaaaatcgcccaagtcacccattaattaatttagaagtgaaaaacaaaatcttaattatatggacgatcttgtctaccatatttcaagggctacaggcctacagccgccgaataaatcttaccagccttaaaccagaacaacggcaaataagttcatgtggcggctggtgatgattcacaatttccccgacagttctatgataatgaaactatataattattgtacgtacatacatgcatgcgacgaacaacacttcaatttaattgttagtattaaattacatttatagtgaagtatgttgggacgattagacggatacaatgcacttatgttctccggaaaatgaatcatttgtgttcagagcatgactccaagagtcaaaaaagttattaaatttatttgaatttaaaacttaaaaatagtgtaatttttaaccacccgctgccgcaaacgttggcggaagaatacgcggtgttaaacaatttttgtgatcgttgtcaaacatttgtaaccgcaatctctactgcacaatctgttacgtttacaatttacaagttagtatagaagaacgttcgtacctgaagaccaaccgacctttagttattgaataaatgattatttagttaagagtaacaaaatcaatggttcaaatttgtttctcttccttacttcttaaattttaatcatggaagaaacaaagtcaacggacatccaattatggcctaatcatctcattctcctttcaacaaggcgaatcaaatcttctttatacgtaatatttatttgccagcctgaaatgtataccaaatcatttttaaattaattgcctaaattattagaacaaaaactattagtaaataactaattagtcttatgaaactagaaatcgagatagtggaatatagagagacaccattaaattcacaaaatcatttttaaattacctaaattattacaacaaaaactattagacagaactaagtctataatgaaacgagagatcgtatttggaatgtagagcgagagacaattttcaattcattgaatatataagcaaaattatatagcccgtagactttggtgagatgaagtctaagtacaaacaactgaatgaatttataatcaataatattgattatattgtgattagaaaaagaaaacaacttgcgttatttttcaatattattgtgaggattaatgtgaacatggaatcgtgtttctcctgaaaaaaatatcagcatagagcttagaacaatataaatatatccaccaaaaataacttcaacatttttatacaactaatacaaaaaaaaaaaagcaaactttttgtatatataaataaatttgaaaactcaaaggtcggtcagtacgaataagacacaacaactactataaattagaggactttgaagacaagtaggttaactagaacatccttaatttctaaacctacgcactctacaaaagattcatcaaaaggagtaaaagactaactttctccattttttccccaaataacacaaaagaagaagttgaaa

SEQ ID NO: 510 - DNA, 3000 bp, Arabidopsis thaliana
aactatcgagaactgagtaacatttccttcacagcaaaagagaaacataaagaatgaaacttttgagaacttacaatagctctccggtgttctctctgatgaaataaagcatcacccagtagaatctgattaaaaaacacagaaagaatctaacttcaatctaacggactcagcagctactaaaatagaaaatatcgacggagaaagaagcttaaccaaattctccgccttgagctgaggactagtttcggcactaacagtaggagaagaaacgagaaagcagccctggatttagttgcatatatagagagaatttcattagctcttgatgaaaactagggatttagaaaaaaagagatagacaatcaaaatgagctaaaagctagagaagttacgagcatttcagcagaatcgtaaagcccatgctctattaaagtcgcgatctgctcctttggaacctccatttcagagacaagagagttcgtcgttagtggcaatggtgaagttttttcttcggagcagcgatgaagtaaaagatccttcacgctcgctcttcattttgaaacaagaaatctcgaaccgagtcaacccaaaccgacattaaccggttatctatctgaaatccatctcggttcattaaaacccgacttttccaagagcccgacttcaccgaacaatctctatctccggtcatgcctccattaccgtcctccacggcgccttcgtcttcgagacatcttcgatcgccggaaagtatcgcgaaatttgcagggagagcaatatttcctgctttacaggggaaatcgtgtccgatatgcctcgaaaatctaaccgagcgaagatccgccgccgtgatcacggtgtgcaagcacggatactgccttgcttgtattcggaagtggagcagcttcaagaggaattgtcctctttgtaacactcgttttgattcctggtttatcgttagtgattttgcttctagaaaataccataaggagcaattaccaattcttcgtgatcgtgagactttaacttatcatcggaataatccttccgatcgccggaggttatctctctctctaagatcctctctatgaagttaaaaatcacttctttattatattcacttggttattatttcattaggataattcaaaggtcgagggatgttttggaaaactctagctcaagatcaaggccattgccatggcggagatcatttggacgaccaggttcagttcctgattctgttatcttccagcgaaagcttcagtggcgagctaggttggtttactattgattctaactctatagcttcatttgcaatctcctttttcgaagtgttagattagttcgccgttgtttctaactagtgttggctctaaatacagcatatacactaagcaattacgagctgttcgattacattcaaggcgcttggaactagtaagtttcattatacaatgtgttcttctctgtttgatgtttgtagtattggggtttacactcttacattattggatatatgttcacattggaagccttatatatacctgcttcgttgtgtcatcttggattattgtagagtttggcggtgaatgattacaccaaagcaaagataactgaaagaattgagccatggattagaagagagcttcaggcagtccttggagatcctgatccctcagttattgttcattttgcgtcagctcttttcatcaaaaggcttgagagagagaataatcgacaaaccgggcagaccgggatgttggtggaagatgaagtctcctctcttcgaaaattcttgtctgataaggtggatatattttggcatgaactaaggtaagatttttatacgctagggttttttcagagtttcaagtagttacaggtttagtatagtagtacagaaaacacataggcaacctaaacctagtgacttgtaagtctgaacagatgatagagctgatatctgtttggtttaggttttttggtcatatactatttctgatgagaaagaaaacatttttcagatgttttgcggagagtatactcacgatggagacttatgatgcagtggttgaatacaatgaggtggagtaatagcagtaaaaaaaacaggtaaagaaattaggatatgtattatgtgggtttggtttcactaagtaggaacctgttttgcttcgatggttttttttctgaagtcattatgttgtattcgcttgcagataaccgagcactatgctctcgtcaaatgaagtaaatagacagacttacaacgcgactgttggtgtcttggaagttcaatagtggaaagactggaccaagtaagagaaaccaagagttaaagagtaggtaggaggaagatgttgagatgatgcaagtttaggtgtggagttagttttgagatagctataggtggattctcaaatagctgacacttagtctctctacttccataatgtacgtctcttctataccaaaaattctcacccccaaagtttctttccaacgcttttcctcacctcatcattttttcttacgtttcgagtaccacctatttcaacaacattaaatattttctataatttgactatcaatttttaataaattaaaactatacatagttttagataaattacacgaagcttccatagaagaggaaagttcatttgaatttctcttctaaaccgtaccttaaagattaaatggtgaatatacacggggaaatttttttaataaacaacgcgttctctattaaggtattgattgatataagtaagcaagcgggtgtaacacaaaataaaatattataaaaggcttcttctataggttggtaagcggcaatccagctgccattgcctatttgacttcccccattcgatcatggtgagctcgtcttctctcttctcctcttatctctttctctaccattttcttttgctttaaagctctctcaatcatgatcatgaagacccccatcacagcattccattcatcctc

SEQ ID NO: 511 - DNA, 3000 bp, Arabidopsis thaliana
actaagaatgtgactgaacaagtaagactacttgcaatggatgaagacgagaacctcactgagccatacgatataattcctccatatgatcaagcaaaagcccttggcaagacaaacattgacagtgatcggattgcttctggattaccatgtggtagtgaaggattccttctgatgtttgctcggtggataaaacttgctagggatctctacaatgaaagaaaagagtaagtttatcatcggatttggattttagcgatgcttctcaaaattttcatctctttgtttccagtaaagttttgtgagtagcactgatagttaattttaattgcagccgatttgacatcacacagattccggatgtttacgattcatgcaagtaagttgtttttagtgtatctctagatttacacctagctttagttactcgtttttgaataagccgtaatatgttattctcaccaggtacgacctgttacataattcccatctcgatctaaaaggattagatgaactcttcaaagtagcacaggtaaacaaactgaaattcctccttccctttcctgaaactttaatcatagtttgcactgaaacaatgaactttcttgttacatctctaaaatgtatggttgactgtgctcgcttatagctaagttatgtgttatgtggttgcagttacttgcagatggtgtaatcccaaatgagtatggcatcaatccgcaacaaaagcttaaaatcggttcaaaggtgacaatctaagataagagtagttattttcctctctaacaattgtttttccaggggatctcacaacttatcatttctataatttttttccaataaaacaaaagattgctcggcgcttaatggggaaaatcttgatagacttgaggaatactcgagaagaagcactgagcgttgccgagttgaaagaaagccaagaacaagtcttgtcattatccgcctcgcaaagggaagatagaaatagtcaaccgaagctatttatcaatagcgatgaattgagacgacctggcacaggtgataaagatgaagatgatgataaagaaaccaaataccgattagatccaaagtaatagtctttactttctctctcactcttatatagatagttatttcggctactaattggtggttttcatttcgcttttaggtatgcaaatgtgaagacacctgaacgtcatgtgaggactcgactttacttcacatctgtaagtttcctctttgctccattgcttgtttaagtctgtctatgagtgaaactataatgtttatgcctggtatgatttggaacaggaatcgcatattcattcgctcatgaacgtccttcgatactgtaaccttgatgaatctctcctaggagaagaaagcctcatttgccaaaacgccttagaacgtctctgtaaaaccaaggaactcgattacatgagttacattgtcctaaggctctttgagaacaccgaggtttaacattacattccctttgactctcacacatgcttcaatatatgtatatgctctctcagtgtctgactctagacgtaaaaaacggatgcaggtatcacttgaagacccgaaaagattccgcattgaacttacatttagccgtggagctgatttgtctcccttaagggtaagagcaaaggatgtctttaactaattagaggaacatattataaacttttggtaatattgaaacatgatgcagaataatgacgacgaggcagagacattgctaagggaacacacacttccgataatgggaccagagaggcttcaagaagtaggttcttgtttaagcttggagacaatggagaaaatggttcgtccatttgctatgccggcggaagatttccctccggcgtccactccggttggtttctcgggttacttctcaaaaagtgctgcggtgctggagcgactcgtaaacctcttccacaactataagaactcttcttctaatggaaggagctaagcagagaccaattgttttttccacttatatatattttgctcatgcttttttctatgtgcagtttttaatcatcttcttgtttttctactgatgttttaattttctatgtgaaattgtgaaagggactagtgcagttgggtttgaataaagatatgattacatggaacataaatgagtcacccgtgacgttgtctagtgtttacaataggactcatctattataactcaagaaatgatgatgagtcttattgtaaacactgtgttttcatatcatgctgttacgttaaagttgttgcggatttgttggaatttatatataatctgcaaaagaataggctgatgatatcggataaacaaataccgaatctaaaacaatctaataatcggtggatttttcgttttgggaaaatctcaagacattaaattgataattgaaatacaaattattattattagtaagaatagtactaattgattggaaattgtaataaacgacttaatatacaaactgaaaaataacaaatgatcatgaaaaacattttaaaaaatgaccaaatgaaggagatacatagatagttttatcaaattttaaaaaatgttggtaatgcaattagggaacatttgtccgtgaaggaattaattagtctctgtttaaaaaactacgaaaaatgcgttttgtaactgttgttgagaagagaagagagagttagcaaacaaacacatatatatttacattattattgcccaacaaatctctctctcttgcccgcttcgtgcccgtctcttctctcttcttcgtattctctctccacagacatgaattccctttttgactaacctcctttttcccctaataagtgaatcttacttcttcttctcgccaagatcaaatttctgggattcttcttcttctctctaattcccttgcgtttgtttcctctgatcaagttccgtcctttttcctttttttgttcttgagttctcgtttgagctgctttttgggggag

SEQ ID NO: 512 - DNA, 3000 bp, Arabidopsis thaliana
ataataactcacaaatgctttagcaaattcacacttgaagactggatctcctattaatttgaggaacaagtcatgtagtttcttcataacatcttggtccaagaacctctcagcctttaagagaatgctcaataaaccacttgaagagataatccttctagaaacaaaactgagcaaactctcactggacatagaaaactccagaagcatttcaaccactataaatgtcagctcgtttgacatcttttggagtatcacaagagtatcgttggatctagcacctttctgaccactactttctgcagataagagcttgttattccaacaagtaaaaagggcatcaagtataggcccaactgaatttgctagattttctgagaggggtcgaatctgttcagaacctttatgatttgaacagaaaccatcaggtttccatgctgtttcatccccacaatcacaacaaccaccacctgtgtagatgattgaataatcgtgggagttgtgatccccattctggaaacaaggcacgcagattgcacaagttgggtcattctcgcatgtcctacacctatatgctatatcattctgtccccagacagagccacaaacacctcgctgatcaagattcagttttgctagattcctcaaagaaacatcaggctcatcctggaacatcaaccactgcagcatattcatgctctccctgaacctctttttcatggtaggactcacagcagactttcgaggccgttccctagcttctttcaatcctagtttaacatcgtcatctgtaggtaagagagcagagactaactctgaaatcttggccgggttagctctaacgaattccactaggccacgtttagagcggtatttcttaggaacccccacagaagcaagcctctacaaaacaaaacaaaaaaaatctaaactttcactccaaacagtcacaaaacaataaaacaaaccaatcacaactacatcaacacgcatcttacaagatactacatatcacgactactaaaacaaagttcatacaagctaaaaaaataatacctcaatgaccaaatcatgcgagctaggagaaactaaaccaaaaagagaagagttggtctccatctccacaattaacgagcggcggatatacaaaaccaccactgacacaacgctgcagaaacactaacacggaactgtgactctccagggtttgttcctcaatttcggagtacaacgaagacgatgaaacttagatagaaccaacaagtgatcgtcttcacaccagagccagaagaactttaaagtaaaacctaaattgttcaaattacaatgattatattacagcaatagaatcggcttaggttccaaaaatcgaagaagaaatacctccaattgtctcagaaaaaaaccctaatttctccgattgcaccaaatacgaaagagtttataggtgaagattggttaaaggcatggcggtttgcggagctcggcaagtctctttaccaattgtgatacgaacgaagaataagtcactcttgtaattttttttttctctttgctaaataatttttttttttgttgatttagtagttgacattttcaattactaaaataaattcctttttgtcatcaattcactagctccattactagtagaaatgtagaatctttggatcatattattttaatgacattaaattttaattttaattttttctgtttttattttggtgaaatttgttttctacttttttatataagttataataaatgcatattttgaaaattagttacttcatttacaattttgtaattaccaagatatgagtaatgagaaacatgaaaggtaaatggcctttgtaaatcaagtcttttttttcttggtcaagaaatcaaaagtctttttctatataaatataatgtcttgttgataaataaaattaaaaaataagatatatatatatatatagtcattagacagagatgaaaacaaaaagtcaatttcagaaatagtaaatgatataataaactaaatagaaactgtttgatgtagtatagtaagtgatgatatactgaatacaactattgtaaaatgaataatgcactaacttaaaaacaattgtgtcccaaaaataaattaaaattttcaagcatatatatatatatatatatatatataattctgcaaatttattgatagacaaaaattatcaatatgccattacatttgaacttttgaagtttaaaaagtatacacttcatcaactatattaatggccaagggcccaagtccatggatgaaagtgaagcctgttaatacctatttcctaaatgggcccatagatatactagccaatttgttttattcacatatgctcaaatcatgttcctcctactaatttcgtttcattcagccttcattacaacccacaaagaaacttcattcacaaggtccacaaaccaactttatatcactaaacaaactaattgataacggttttctaaagataaatctccacaaagatgatgtcaaacaaaaaaaaaaaaacttgaaaaggaactgaaaaaaaatctccacaaagactcaaagtcttattagaaaaagtcaacaagtcaacgatgaacagaggaagatgaggaagaagacaaagtccaatagggcgtacccaaaactgagagagaaagagagaggaaagagctcaaaaaaaaacatcttttcttttcattttcaattagtttcattattatcacaaaagacttttcttctccgagagaacaaaaggttaggctttattgattactagccagctcaattttctttctttctttctttctttctctgggagtttgggattttcttaagggtctttttcaattctcgctccattttgtacgcatagaactgggtttgtgtttacacacataaagctcttatcttttttcttctttcaatcgagaagattatagagctgagtgactgattggtggtttcttggagtttta

SEQ ID NO: 513 - DNA, 3000 bp, Arabidopsis thaliana
gcaattttgagtgcattgtttgatttcttttgttcactttattttgacatctataaatcatcatcaactaaaataattataatccataaaataatcattgtaatacattatcatcgtactacataaaactattaaagatttgttacaacttataagaaattgtttattcaaaaagaaaaaattcagaagaattagttagatatatattactttaaatcttttattcgtttaattgacttttaggtatttgatattcaataggccggaaaatttttaaaccaaagtctatatatataaaagtttattttttttttcataaatttacatcatcatccatattcaactttatcatcatcattaatattatgttgttgtggttaaccatctgaattattgacctactttcgtattaatcaattttaattttgtacttatcctttatcttttaagtatcattccacttatgtatatatgttactaaaaaacatatggatactatcaaaaatatatatgttactaaaaactatccatatttttttagtaacatatatacacaaagagaaaaaaatcaaaaatgataatatatgcatatatatatatatatatatatatatatatatctgtgtgtgtgtctttctatgtgatatttcattatatagtaccgttattctcattatttttgtaaactccaattatcatacaatgactaaatccacctttctttttgtctacatcatccttattctaggtttttttaaccatctctaattcagttataaaatcatgtagttttactaccatgaaaactaactttgtgtttgtgttttaaatattacttttacaggatcaatggtgaatgagattcaaggacaaaacgcaatatgtcaaaagtttttatcggaaactgattgtggtgctggctcgtgtaccgcgttgtgcttgcagttatggaaaggaattggcaaatgtattaaaacagatgatcataaattattatgcctctgcaaatatgagtgcatagtttgattttttttgttcactttattttgagatctataaatcatcatcaataaaataataattttaatccataaaataatcattgtagcaaattatcatcgtaccatataaaactacttaagatatgttacaacttacaagaaattgtttgttcaaaaagaaaaatctcataagaattagttacatatatattatttaataattaacttttaggtattacatatttaataggtcagaaaatttttaaaaccaaaatctctgtatataaagttaaagatttaaatcaaatcaagtacaaggatgagtgatttaaatattacaaagtttaaaacataaataagagagacattctccaataccataaaatgatagataaagtaaaacgagatagatttcatgagagctttgagacaaaagctaaaaacattatggcgcatgtgaaagcacggttagtcgaaagattttctacgagcgaatcaggacgacaagttggtcacggtcaaaagacgaggtgacgttaaaaaggattccatgtccgaagttctcctcggggcaaaaagggcgagctggaattgctcatcggtatggagaagagtgttgacggttctctgctcgggtgggattagaggtaaaaattgccatattttcgtatttattttatgatattgtgcaatttttcataatctatcacataaaaatgtggaatatgataaaataataaaatgaaacgaattttacgtttatattagactatgtgcatcgggggtttattcaaccgttgaaactcttacaatgagggtgttgaaaaagtaaaaaaaaatttgtggattaactatagttgaaaagattcaacatgttgaacacaaataaatgggcgtcacttgcgacacgtgtcttcttttcactagatattaaattctgaaaatttttatatttcaccctaaatatttaagattagaactaatttatttttttatgaatttaaaatcaaaattaatcaaaaaaatttctttataaaaagatccttgtttcatttgatttgcacataaaaaaaagaagtttattttactataactcttttaattatcttcacatacatttttgtttaaatttttatacatttagaaaaatggatttcaacaaacataatttgtttgtattttataattattttaacttaaatttatttgataagtgttattaatatgtaatttgaaacataaaaaatatgagataaaaatagtgggttaaaatgttgaatattattaaacaaaccattgtaaatgttaaaaattaaacagatgttgaataattagctgggaaaaaaaataaaaaataatatggagtgttaaaagcaaataaataagagtgcttaaaaaacaaactaatatacatagtcttaggctgtaaattcattttaaaaattccacaatataagttatttatacctacaattattaatacagagtctagaaatgtatgagtctttcacacatacttttcaacgtgtaatccgtacggacgcgatttcttctgttttcttttgtgttgaaacacgatttcttctcttctttctccttatcttttaaggaatggcgtaacgttttgtgtctttttccatcttaatctgctttctcgacaaagaaaagcagagaaagagagacttgttatactaaactcaatctctggcttttagttttgttgtctctctccttcagtttccaggaaaaaatctctttctcattaagctgttatatagatctgtgttcatactcttcttccacaatctaacccaaaaaaaaaaaaactttatttctctctacaaatttcatttgttccattttctcaattttagaacttaagaaacccaaaaagcaaatttttagtacattttctggtttaactaaagtaattaatttttgtgttttccatcaaaattccactggttttctttagaatttttttatctctctttaagac

SEQ ID NO: 514 - DNA, 3000 bp, Arabidopsis thaliana
gatcaaagactttaaatttggatgtttctctcaaattcaaaatgtccattaatttaattgttttttttaggttgatatttggactaatctgatcaattcttgcttgccgccctgaaacgaaacattctatgcactcaacaagtcaacatgacgtcaattggttgaaacataatattatctttatctaggaaattctaagcttttgttcattattttcagtattattactattataacattgaccgttgacaatgcaagctgtaattctttctaaaagactcaatgttttatcataactcataatattataactttgttctcatagctaagtttagtagagttcaccgcctcaccggctaaggaaggggtcgaacaaatgagattgacagattgttaataattgaaaatatttgaaatgttttcttgatacatattctttggctggtattatgcaaaatccacggaaaatcttcatctttttaatccttaatatacgagaaaataaaccgtaagatgcaagttaagtttttcttcttacccggcaagaatgtcctttcttggtctacaattaacaaatctaaaatgatataattttttaaaagtaattggatatatacatcttttgtttattttctaattctagttttttttatatatcatggtatttttaaaataaacttatagctgaatttctttttatgctcaatcagtttatacatatatggatgggtatttggtcctctctttttttttggacaaagatttttagtcctaagtggcgttccgtgattcaaatgtaaagacatagtttcttttaccaaaagagtgtaagacagatattgtttagcaatatcttaaggagacttcttagtgagggaaaaaaatagaaaggataaaagaacaagtgggtgtggaatgatctatagcaacaactttacatcaacgaatcagagaaccttttttacttctctaacgtctaacctaaagaatttagaaatttgctattagtcgggaagaaaacaaacaacaaattttaagcttatttaacccaaaaactgagaaaagaaaaaggagaagaaatttcaagcctaacacctggagaatgagataaaaagggatccaagaaacaaactagtgggtgttgaattatatctcttgttgaagcaactttctaccacttattattacccgcacacgtttgatttattgtattcacacacattttaatttcgtgcatttgaatgagtaaacttaaatacaataatattactatatctgaataaaaaagaacctcctaacttcagcttcacttgttcaaaatattcaatcatattgtcttctttttttgacagcacatacaatcatactaacaataacatacaaaaattaagaaatactaaagagtaaatgtgcgtgatgactgatgacataaggaatacataaataagtcggactttaagtggaacattaatcttgaagattcttctgcgttttgtaatgttaggtatggtttttataggatatttacatataattatatccaagttgatgctcattgatccactaattttccgattctacggggtaatatatttttttttttgatgaacattgtttgtataaatcattataaccatacatacatgactaagatgaataaacattcataaatacgacaaataattataaaatttattatgacaaaaaatttcttataaaattttcaaaatatatatttttcctcacgtataagatttatacaataactaggtttccaaacttacatatttacaaaaataataattaatatacctctacttagagaaagaggaataattaaaaaaaaatttggaaagcctaatgcataaaaagtcttgctttaataatggattggatcctttttattctttgtttaaggaaaaataggttcgtcgacagctctacttgtgagtaatgactaatgagcacatccgtttttggagaaattagccgatataaaatattgagccactttctgagattatgcactaacatagtatcgattaaaatgaaatgtgaatgacgccaataatgagagaaatgtgaacacacaattttatcgataacaaaaaacaaacagaaaaagagcaataagaaagaattgagaaaggcaaaggcgcacgcttagacaaaaagaaagcaatcgagaaaaaggaaaaataaaaatagaaataacaagaaaaataaagagacttgtggtctgaaaatgcgtttcatacatgcgcactattaagcagaaaacaccaaaaaaacaaatcccaaaaatgaaaataaaaacaactttttttgggtagagagaatggttcttggtttaatttggatttgaattttgcatggttcaatatttcaattattaagttaatcaaattatattaaattttttttttatatacaataaccattcgactaccaaaatgaattgaccaatcgaaagggattagaattcggtttaaagcaatcggaaactaaaccagagagaattgtaacaagaccggaccggaccaaaacaaaacagaccagagtggactgatgtcttaatcgtttttgttctttattttctctgagaaagagtctctgttctgatttgtcagtggaaaaagagaaagagaagtgggacccatctccgccatagccaaagacctctttctctcccacctcatacctctctactctctgcccatcattgcccccgacgaaactctctctctctcgctctctctctaaaaagagaaacaaacatttctttagtgtctctctctttcatcatctctttaccttttgcttcttcgaaaaaaaaagagaaataaattctaagaagagaaattgagagcttggtttttctttattggcatgaatttgtaacttaccagagataataaagttagggttcttttttttcgttcttataaatatagtaatctttctatttttaagtgtgtgtgtgagtgttgtttgggaata

SEQ ID NO: 515 - DNA, 3000 bp, Arabidopsis thaliana
tgccagagagttgaagaaatcagggaaggatgttgccaagacaatggtgatggctgttactgcaggaagcataactccttgtatcttaaatagcgtcgtcaacgtaattgcagctttgcatatcaggaaggaaactgatagtgcaattgaagttgaaaccactctgttcttgtcctcgagcttgtcatccttagtcatgtcagcatctgccaaagatcacaaaaacttgaatagtagtgtttatatgtggatgcaaatgcagttagaagatgagaaacgttatgtaataatgtcaaaactcaaaagtattgaaaacttattatcaagtcttaatttgataggcacattatatgtattaataataactatctttaccaacattcactcaaatcaatttgacaactaaccaagtagccctagagtcaccaaatccttagttggtccgactattcgccataagttctttagtaatcctctcacattgcaacatacttacataccttatatatacaaaatgtgatcaagatggaagtttaccaggggaagatgctgaggcggtctcagggggtatctttgaggccaacgcaaacaaaaccatgaagtgaagagcacatatgacattatccacagctacacccgctgctataacagatggagatatctgtagagcctccgatatcgcaacaaaattaagggctgcagaacaaaaaacaagaaccaacaattttattctcattcctcttgaagaatccattcccaagttgtgataaacatcttacaagccaatttagcaagattttcctcttttttcgataaacgaaaatcaagcaaagctagaatcttttcggctaaagaagataaacattgagtacctctgtctgtaaacaagccaaagaagcaatgaaggggctccagacaaacttacatccaccaatgtaactccccataagagcagctgctattttccagttatccggaccaagcgatctcatcggtaccaacataaaagccaccactgttccaacaatcgtcgcaactacaacaaaccaactcacaaattaataaaccactcaacacatcatcaataacaatgtcacttcacaatcaatctttttaactaaaaccactcaaagacataaacttttgttagtcttaagcatgaatccaaactaatcccaatccaaaaacttgcctttaagcaaaagactaaatctttaccagatccaattaagaatgcaagaagcaatgatccagtagatcggataatacgacggagatcagctctaaacaacaacaatggaatcgtatgcggcaagagaaactccatgaagaagccatacgacggcgtttcaaacggaattaaccttaaattgctagcggcgagcccaagtaacgtacttgtcaacgcaccactcaccatacttccaattttcgtcttctccgacctaatgaagtcggtaatttcatcagtatacaaaaccctagtttcaacagagaggattgaggtgatttaccagacaccgaaagctccggcggcgaagagagcagcccattgtgaccagtgatcgtctggggagattagagggaatcgtagttgtgagtagaccttcacgcgccggcgtcgagatgaaacaagacgatgtggagtgagtgttaccggcggcgatttgttacggcgtatggttattgatgatgataagtggtggcgggaaggagacacgtggagcgatgagattgtgggggacagtggatttggtgataccactgtgaatagaagagccattgcactttttagatacaccaattaatgtttgaagtcccatattatacttttggaaacttattttttttgtttccttattcggctaaacaaatttattgagatatcaaattgacgagaagcatattaatataccacataatgaatatgataaaagtttaaaataaaatttaacaatattttttttctaaaactttactctattttctatttttgtaatctatttcttgatacgaaaaaaataacaaataagaaataaataaaatcgataaagaaagtaacataacataggaagacgaaatatataagaagaaaatataatgaatagtatgaaaaaagaaaaatagtaaaaaaaaattatgattagcttcgtttggtggaattctcttctttttagtgttttcatgtattttattgtcttcttgtttatcaagaaaaagaagttaatctagactttgataaaatgatggatcatggatgcccataaaaagagtacttctaattttttttctataacttttttaaaaaggatgcattcactataacaaggtttgttgtatgaataaaattttacatacactcagaaaaaagaagaaaaaaagaagaagaagagtacttctaatttggtgacagatgcttccttatatttccttctaattattaaattagtatcgtttaggtctattggaattaatgagtgaaatattaaaccttgcctacaatacactaattaatttattttttgtaataatgtgtcggtccaaaccttgttagttacgcaattaataccataataatcacaccacctacgatgagttaatccgtaacaccacaaattatatctcaaaactgtttctatctaattcaaaaatgaatcaaacatccctactcatagcgtacacaaatgattaactaagaattaccaaatcagtgaaaatcaactatatttaatagaaagcaaaactttttgaaaatgattgccaccgaatcacaaacaaaatcaggtttaagcttcctttggtttcccattgctgttgacaaacttcgctgcctaatgatttcacaaacactttctctttcacttacctttagtgggaaaaaaatacgaatacagagaagtgacagcaaaaacccactttctagtttctccatctcttcttctctttaatatcatcaaaccaaaacctttctcaaaccttccccaaaaaagcttcactcta

SEQ ID NO: 516 - DNA, 3000 bp, Arabidopsis thaliana
aggagtgctgcttttcgtccttggaatcttggggttgtacaaattcattaagaagcgaacgaggatcatccgcaacaaaaactttttcaaacgtaatggtggcttgctgttgaaacaacaactaattacaaagaacggaaatgttgatatgtcaaggatatttagctcaaaagagttgaagaaagctactgataacttcagcatgaacagggtgcttgggcaagggggtcaaggaactgtgtacaagggaatgttggcggaagggagaatcgttgcggttaaaagatcgaaagttgtgggtgaaggcaagatggaagagttcatcaatgaagtcgtacttctctcacaaattaaccataggaacattgtgaaactcttgggatgttgtctagagactgaagttcctgtcttggtttacgaatatattcctaatggagatctgttcaagcgtcttcatgaaaaatctgaatccaatgattacacgatgacttgggaagtacgtcttcgtatagctatagagatagcgggagctctttcatacatgcactcagctgcatcgattccaatataccacagagatatcaagactaccaatatactattagatgaaaaatatagagccaaagtatctgatttcggaacttcaagatccataaccattgctcaaactcatctaacaacgttagttgcaggcacttttgggtatatggatccggagtactttttatcaagccaatatactgacaagagcgatgtttacagtttcggggtggtcttggtggagctcataaccggagaaaaaccactgtcaaggaagaggattggcaactgatttccttgaggccatgaaagagaacagagtgattgacacaattgatattcggatcaaaggagaaagcaagctgtgccaagtgatggcagtcgcaaaactcgctcgaaagtgtcttagcaggaaagggagaaagcggccaaacatgagagaggtttcatttgagctggagaggatccgttcttcatcacctgaagatttagaggtccatgttagaaatgttgatgcagaggaacaaatcatggaaatcaacagagaacgattttgagggtatgtacatgagtgacaagatccattctttatgttaaactagaagttgcccacaaatatgcctttaattgctttcaaaatacgaattaaatacgatgataacttgtagttaaagtctcaacttgatatgtttatagataataaaattttagtgtattaaaatctttcaacaaagtttaaatctaagaccaatgaaagaaggaaacaaagttgaagaaacacgagaaactatgtagatcaaagatttgtcctccattccatgcatgaactttaaggctgataccatacggcatatcttcactatgatcgagtatattactctggatttctctcctacacctgtggccatcttcttgagcatagaaaccaaaaattcagctatcttcatggttgatggttcagttttccagttattgctttcttgcgttcatccaagtagatttggttgttgtctgttcgtataggtcattttcaacaatcacatttaggccatacattcccaacgtcctctagcttcttctagcactttttctcttctctttttatcctaagctcaatctctgcaaacataaatacaaacctatagatgacgtgaagagaaaacctctctgagtttgacttgtcacattctgaattgtcaaagcttttgagtttcactgatcaatgtaaagaggctatgttaacacacaatttagattttttttctaagacataatttagaaatttcttctgtcacgaatcatattccatctatattatattctctaaaacacgcctgcataagagacatcaagagagaaggaagactgtatataccttttcggcctcatactccgttctccaagaatagctcttaacaattcctttttaccatatactgttttgaatttcaaaacagaagacgatgagcttcacaaatccgaaaaatgcagcccttgcaaaattttggatgcaaaatatattcaacggaaaatatgtttttatgttatagatagactcaaacatgagtactggatgttaaagccctctaagaacatggataaagtgtaagaattaaaaggcaggtaaaagtataaacatacaataccatcggcgaacagtggcggagatggaataagattatgggagaagtaccatcaacacgatgatggcgtgaccggaggtacctttagccacgaagggaagtttcgtggtagggtaaatagacttttttttgccgtttcgtttattgaaaatcatcaatgagtaagtaaagagggtttggcaaataaatttgccgtttttgtttaataaaaattaatgagtaattaaaaagttttttaaggaagaaaatgtaagataataaatgaggaataatatgtggacacatgtagaatgtataaaatgtcaaatgtccaaattttagagcaagttaagaagaaaccttgtcatattatgtaagataagatgtatctttaaaattatataaccttagtgacaagaaaatcaataagatcccatcgacagccatcaaatcaaactagatcatttaaatctgactcagtctgttctcacttcttacaaaaaacagagcactctgttcttacttctcacaaaagaccctttcagtggtgaggttgctcttcttttgggttttttcccacctaaatctggagtttgacttagctggagtagcgtaaacagcactagaggtcaagtttctcaaatgttgattcattattagaaaatagattcccttaggtgtagagttaacattgaataagagtattttaatgctactttgtaacatgcttcacgtttctttctaaacatatcttgaccttttcatcagatcagacacgtacatacctttttcccctagatgaacagatcaatcagatcaaggaaaaataaacagaatt

SEQ ID NO: 517 - DNA, 3000 bp, Arabidopsis thaliana
tcacacgtcgctagcgtttcaaaactgcttccactcatccttcctttgatggactcagaatctgtgcattgtggtcgccccaaaagcaaatcatatggaagaggagcaggagcacaaaaggtgtcaggtatagatgtctccaaacctatatcaaccaagaggcctgtggtgaatgctgatcccacaccagcacgggttcctgaagggacaagctcttcaaaagattctggacactgcgtaacaaacttttaataaatagaaactttgtagagtgtcacaatcaaataactgtagataattcagaagacatttttcaaacacagctcactcacgacctctagtagtctactatcgaccactcaagcgagattgttacaagaaattgttgagattctaaaatcatgctcttgtcccgatttgttttaactaaaatcataatctatagatagtcagtagtgcaaagcaacacaaatgcaagatggtgaaaaggattactgacataatagtaaacaggtgttccaacaagatgtgacttcctcgaagaactacagcaacctcccattttcaccagctatagtaataattaagcaagagtagcgaacaacagtccttgaagcattttacagatgcactgccactgcaggaaaagagtgaactgaacaacgattacttgaatgcaacaagattaatcaaaagtactcttaagaaaccccaataaaaaaaaagtgattattacagtgttagtaagcaaaatgacaaaagaaaagttggtctgatggcaaagtcatccataagaaacacaaaggtatgggaagagtgaatagtgagaagaacattacgaaacaagattaatcaaagcagacttgagaaatcccaataacaagtgattattacagtgttaataagcaaaatgacaaaagaaaaagttgatctgatgccaaagttatccataagaaacacaaaggtatgggaatgttccttatgctctgttgtaatgtcccatcaatagctgaaacttgaatctatattctaaaacaacctctaggattcagtcaagttgcaatgaaaacagtgacgcgagcaaaagcatttcacacttgagccaattttaatcaaacacaacacaataaccttcaaaattggtaacatcattgatatgtaactctaccataagatcttctcataagaatagacgacaacatgaacacagtaagcacatctaaatcagaaactaaacaacactaaacagtacgcgaaccctaaaattgaagaagccgaaaagaccaaaaacaaaaagtacacgaaagccgactccgggaaacaaaaaaagagatggaataattaaccgatgagagcagtaaacgaagataacctgagatgtcgccggagaatttgatgttgtcgtgattctccggtgaagaaaagtgagaagaataaatgctggcgacggagggtttcgacacacagagctccttttctctagtcgaataacctcatcatagtaagtaattatactgtaatcctactttactttatttagtttgcctaattattctcaaatctcattaaataccttttaaatagtacgacgtcggttaaggatacgggctaatcattgggcttttgttttctgaaacatgggctataaacattttagaccatggtccattctacagaaggtcaaaccctctgtcgctatcagaggctattgaatattttgctggtaaggtctcaattctcatcatccttcacctgcctatgaatcttccttgttaaccgtaacctaatattgattgacttctaatcaaagtaatttaatctaccattttattatttcctctaatctaagcctttttcatataaaatgtatctaatagtaactttataagaaaaatattatacctttttcttggtatctttgttgtaaaaaaaaatacaaattaaatgcgagttcgattattgcattaatagagatagacccatctggcatttaatatggtggcggcggaataatcgctaacaagatattagttgaaaattttcaaatcattcggatagattacgtctggcattgaactaattatcctctataaattcaataatgacagaatttagtagatgttctaaatactaaaattatttaataatcttacatatgcaattttccatgtacgtgctgttttggagcgtttaaaccgaattaaagtactactgtaaataaattgaatcgaatttaccgaaccaaaattgaagaaaaaaaaaattaaatcgaaccgaaccaaaaattggaaactagtcgaataaatattaaattctataaccgaaatatctgaaataaaaccgaataaatacaaaccaaaatattttgggtaaaatatctaaagtataaatatatttttaaaagtgttaattatttctagactaaataactaaaaatacttgaaaatataaataaaatagtaaaaatatttggaaatatctaaaaatatttaaaaatattcaaaataaccgaaatattttaaatgaaataaccgaatggatactaaattttaaaatcgaaaccgaacagaactttcaaataaccgaatggatactaaactttaaaaccgaaaaaatcgataacggaatggataactgaacgccgagaactactattatatacaaagtatttagttattcaataaaatttgaaaccaatcgttttttttcaaaattaataattatcgaatttaaatctaaggaataaaaaagcttattacaaatcattagacaaaatgtaataaaaaaaaaggaaattatacacattaattatcttagcttgtcgagtttaaattttgttaatcagagaacgtcaagttgtacagctggcgtcaataaatacccaaaacagtcgtctttttcaacggagaagaaaaagttgaaaaaattgtaaagtcagtctctccgactcttccttccttccgtgttcaccattgctacacgttctccacgaactttccg

SEQ ID NO: 518 - DNA, 3000 bp, Arabidopsis thaliana
gatgcatcgtacatgcatgtattgttatatttttatataaatatcgttgaaattggtattgtgtcgtgtaaaggtggttataatgtataataattcaaaatttctcttcggtaatgtgatcatttcttttacttaaaaacatcctcttgttaaaagtgtaagctcgtatactcaatcaatagggcaatacttctattgtcgacaaaacaataactattttgggttttgggacacccaaaaaagggaaaagttcttacaggacatgcagacacgagaacagactgtcacatgcaatgctgatcgtcattctcattcatcaccaagtttctcacgtccacatatgtaaaagcagataatgcagtttcatcatttttttatatatatgagaagtgtaactataaccatatcgtataaaaaatctctatatatagatagacatagatttaggaaatatttctttcgattttcttccaaaatccagcagcgccgtcaagattcttaagaatgatttagtcacagctcatcgatgtattaaatgattataaaacaaaatcacacagctcatcgaatgcttttatgctcaagtgctttgtctactttacattacattcataaaacgaaaaaaaaaagataaagataacttcttcttatgaattctagagttttcagtttttggcatcttaaaaatattaagattctgaagttgtaagtcagaaatttttgaaaaagtgtaatcttgtcaacatttgagcatgttatctacacattcttgtatcaccaattctcgatgtagtcgaacttaagaagtagataagaatggcgtggacctcaaacatatattacaaactttaattttcaataaaactacaatattaggttggacgttttaaaatgtatactgtaaaaaaaacgaatgttagaaaattattgacgagatgtacaacaatatttttctaacaatgtattttgtaaacttctgattggcatgacacgctcgatcgcaaccctgctagcgactaatcaaaataaagacgtccattcttttctatttggctttccaaacaacaattaaccattttggaaaatgcattactaaactcacaactccgtcgatcaacaaaatcagaaactgcatctcttctatttgggattaccctcctctttgcaacaaaatgctcatgcaaacgtatttcgcagaaaattacccacgaaaatttctctcaattttgcttatactttctaaatttcgagaaataatatttttcttcatcttttgtaaatgcgcttctttctgttagcaataaactgtaattataataatttgtttgcaaactaaaacaaatgtactaaaatggcagactaaatttaataaccaaatagtgtttattattgtcatgtcatacaccgaatttacgccatgtagaagtaaaagatcaaattaaataacattactgctgaatttttcgttagtataattaaaaagagaacatgtataaggtagactgtatgtagtctatgtagatgttatataaatgattttttttttctttcaactatatatagattagctaggtcggttgtattacaaaattaaatagtagtaatattttattttaaaagaattgtgttgaaaattttgatcgatcgcctctcgctctttaataagccattgactctttaaaacaaaaaaaaacttgaacaaattccatttgtctattattttaataaatacggtgttaaactaaaatagtataaaataatatccaataaactgtatgtttgttgacagaaaagaatataatgattttaaaacttcaaagacccaagtttcttttgaccaaaatctattgccttcatttattataactcgcatactgttttactcatacagatcattaaaaaactataagcaattacataacttgcttacaatcattgaaatagacgcacatgtttgccggaatgatgaaaaccatattggtcacacccttcacctaacaaagggtgtgatcaccaaaaatcacatcacttgcttaatttttcataaaaaccgatatttctaatgatgttaattggcaaatatgataatatatgaaatatttactttgaaatatgagagtaaaaaaattgaaacaacatttcttttgttatctaattacattacgcaagttattttggttcaagttaccccaacattgcatgttatcatgttatcaatcaatacaataatcgatcaagttgcatagcataatagcatactccatttatggaactataattactcaactcgagcttcgaattatggtggaaagctgcagcaaagtattgcaatgaatgcggcatctatagctatgccagtcggtcaacacaatctataagctatagcactactatagtccttgtggtcctactcagccaccacaaaaggttcaaggcttcaagcttcaaaggttcgaccacattcattcacaatcatcatttaacacataaataatctccattatcacctccttaaattatgcttcaaaaactttcttaattaccgaccatactaccaaacacaaattatgattccaatttaatctccattattacaaccaccttccctcaataataacctcaaatcaattaaacccaaatttccattattatcatccatatctttaaaacactacttattacaaacaaacctaatccctttattcatacattattacaccttttatattttcataacaaaaacgcgtagtttctgtttttaacggaacgggacggaaataataatatggttagatttataatagtaatgatctgttgaataagctaagtaacgacacctcactcttcgcttgcttccattcatcatctctctctctctctctcttcccaaaaatcaaaaaacagaaaaattaccaaaccctaccaatctccttcttcctcctcctcctccttccttcttcatcctcctcctctctacgcgccgcgcgtgttctctaatca

SEQ ID NO: 519 - DNA, 3000 bp, Arabidopsis thaliana
cctggttattgtttcagcgatttttttgagtttgactacagacccttactccttctcaacgtcattatgtcttgtgacaatgaccaattttccacttctcggatcgaccgaagttgtgtctccgatttaccttcttctcgtatgtggcattgtgttctacaacttttgtctccgagttagcatggttttatcatcggactattgtatttttatctttattgcttttatttttgttgtactaaagtctgagaatgatattttcttaagctttgtactaagtttgagtgattgaacgaaaacaaagtttattgacaaaaaaagaaaaggaaaacggatagctttcttggctgaactatagcaaatgcaatttgcaatgttttaagtcgttaaggtactaactactaatctcaaaagatgaaaaagattatataagtgaataaaatatcaccgcaaagtgtttatatgcatactttatctttcaaacataccagtttccgataaatatacaacaaaccttgtgtttacgatgtaatggtgttctcaattaaaaaagaaaagagagcacttttctatataacaaatacaagttgagaaaaaagccaaaattgactggaccgaagctgtaggagaatgggggcgataggaccaagggagagttacaattttatcacaagcttgtgtgtgtatgttttgtttcttttctttaaatttggatgttgacagctttaattttttcctaaaaatatacactagaaaattagagaatatttagaaggtgagaccagcgaatgtcatgccacaaatcatgttcataatgttataccaaataatcataatgtccccatgtgacgctttacttttctatattatctcgtaaccccactcatacgttttagaagaattttcacacaactaagataagttgatttttgaggcaaaatattgtttattttttctatcaataaatcttcgtaagactttccaataagagaacatttttcttattcctctcgtgacagaagcaaatcatcccatccacacaaagtcacaatccaagacacaagcccaccaatagagactccatctcctcactaaattcatctacaatagtaattcattattgctattatgttactataattgctttaaaattgtttcctatgaataattgaatatcataagcaatatgaacaaagaatgatgttcaaatcaaaattcgaagataaggatataaagttataatcgtgttgagtcatacacttcgagctaaagtttttctttaaacaattgatttagctaccacttaatctagttggtactgaacaagtaacaacataagtagaagataaagagaagagaatatcttactttgggactattagccatgatgtccacgaccaaatcggcctcctcaaaatcaatttttgtctaattttgtaatgtgagactttataacttttccataatatatagcggacgttattattttactcaaaattgtatgtggcttccatttgactactaaatgaacaatattatgaaacaaataaaatgaacaaaaaagttgaacaaaaaaaattatttgaatattttatttagaaaaaatctgttcaataatatgcaaaccaaaatatctccggcatgtgtaaactaaattgactatactaatttaacaaattatcaccgcaattacgccgcgttgaatttgtttttccttagatttggcgtgggtcatcgaatgtttaattaaattaacataaaaccaagataggccattgaccaaaatacaataatattttcataaaaccttatattattttctgaagagcaaaaacattatctgagaatctggagataaaattgacgtgacattaagaaccttaatcgaatttgattaacaaaatatttctttgttgcccgtttcaattttagtggattattttggtgtaacttgacattttagataattctattaataatagattaggggaaatgtcaatgtaataggtggcctcgaatttgtgttggtgcactccagctgtcttccttcgctttggagcaagtagaatcccaactattttctccacacttaaaaaaccttaaattactcattctcaatcttatattttctataaacgcaaatattttatgaaattttatactattaataatctaattccctaaatatatatatattttgcattttttacatcatatctttttttgcctaaaattttatacgagaaattttatactattaagaatcttattgcctaaaattaaccacttctttttttggtgttctatttcatgcaccgatattaaaaatcgtaggaatatcgatggccaaaataaaataaaatggaagaggatctaaactttgtattttatactggtcctagtcctagaaaatcgaattattcagtgttttcattaaatgcatagttcaacatattatttggcatgatagattgtctgcaaatgacacatcacttttcctttctgcaaaaataaaagactctataaagtaactttagaatttattcagttcctcaactcgatctagtccctttaattaagcaaacataattatttaaacaactcttttgagaaaacattttttctctttggtcaaataacaaaacaaattaattcttatttctacattcaattaaaaacataccaaaacatctattaacttcttaaatattttttctcaaatttgtagtccaaaaaaaacacgacgcgtatgttttttttgttgttgttgtgtaataagaagagaaagaacgtaaaagaattgacgcggacgaatcgtgttagacccaaaaagaacagctttcaattccattgtccaaattccttatcaaaaaaaaactctactctcggtggcaccagatcactcctcctctctcttctcctacctttttcacattctcttcttcttcttctcgtgagaaaaagaaagagagattctttattcattagatcgaagcaaaa

SEQ ID NO: 520 - DNA, 3000 bp, Arabidopsis thaliana
tgcggagaactacaggttgtattcgagaagtcactttgtgaagggactagagctgcttttattgctagttgtttatcaaatctatgggcattcataccggagttcaaacctttatctgtatatcacagtctcgatgtggtttatggttggttcttggttgtttgcaccatttatattcaatccttcggggtttgagtggcaaaagacagttgacgattggactgattggaaacgatggcttggagatcggggtggtataggcatcccggttgaaaaaagctgggaatcgtggtggaacgtagagcaagaacacctcaaacatacaagtattagagggaggattctggaaatcacacttgctctccgctttttcatttatcagtacggaattgtttaccagctcaatatctctcagcgcagcaagagctttttggtataaaaaaatgttccttcacttttcatgcatcaaagagctttttatgatcctttagtctcagtctcttttttacttcctctttgtaggtttatggactctcttgggtggtcttgctcacatcattacttgttctaaaggtttcacaatccttcatcctttatacacacatacatatagtcataaacaatgcttatataagcttaattacttactttgagtgtaaactgtgtcagatggtatctatgggcagacgaagatttggaacagattttcagctaatgttcaggattcttaaagcacttctcttcctcggctttttgtcagtcatgacaatattatttgtggtgttcaaactcacactcaccgatctctctgcttcagttcttgcttttcttccaaccgggtgggcgattcttctggtaaatagccatcaaaacccccttcagaatcatagtatcggaatttgcatcatgttcttagaaaaaactaatggaaatttctctcagattgggcaagtactgaggtcaccgatcaaagctttaggggtttgggactcggtgaaagagctaggaagagcgtatgagaatatcatgggacttgtaatctttgcaccaatcgctgttctgtcttggtttcccattgtctccgagtttcaagctcgtctgcttttcaatcaagcttttagcagaggccttcaaatctctatgattctcgctggtcggaaagacaaagcaacttcttcgcacaagtaaaaccataaatactcagtgttgtttccgggtttcttctgtcttaagcaacaaacctgcttctttagaacggtgtcgttttagcgtagttcaatagatgtctataaggttatagggatattttagtttggttggacttggacacctcacactctcatcacactcatgtgttgtagttatcacaatgattttgacatatggtctttaataatatagctcaattgatttcttttggtttctgattaaaattattatttgcgggaaaactcgatgaagaaaaatattgacttgatactaaaattcttgaatgcacatcatggaaagaaactccatgattcttttctacttgtttttttttggatgattataatattaatacaacttctagtcattgctagatacaccaattacatgtccgaggcattatatgatgaaacttcaatttcattattctttggcattttcttgcatgtgacaaatattgtattgtatcaaagagatacaaacaaaataataatgtggtgttccttagagtttatcttcattcttttactggagtcttaagtatagaaaatcaaacttaaatccaaaaaatatctttgatcataatataaaaatgatcaaataagtttcaatcttgaagtcaaacacaagaaagtcatgctacttcagcatataagaagaagataaggaggacctaaatttccaaaggctgcatctgagaattacctcttttgtaatttcgttaatcctttatccactttttcttctctatttttatttatttcttaccttatagtatataaaaaataattgtaatattgttgtatttaatcatgatccagctataaatgacacagttgtcaaagttcaccatctttgctttcccttcactgctctctctctttctctctctttgttgattttgttttcctcaaattgcaaatcaaagctttctttccagctttagaacacactctcaccaacaatctcacccaactttttttccttcttttaactcctcactaattcctaatcccacaaaccctaaactctatctctttaatcccttccttacatacattattcagtagttgagtaaagtttcaatctttcttctgattccttgttggaattacctaaattttctgggtttattttggtgggctcgtcgagagatacttcaattgcaattcatcgttaagcatatctatgctaattgcgttctcttctttatttcactttctctttggtttgcttcaatatcaaagcaaagagggaccttttcgctttgcgttcttctcttctaatcgaaaagacaagagcttagtcaccacattctaaggtaatttcatggaactaaaaaaaactgcttttttgtttttcaaggattctactttcggtagcagtttatgattcttctgtgtaatgtatatcttgcttcaatcgtaagtgattcttttccaatagtttaagagctgggtttcctcaggttttttgttttagtgacaaatgttggaaagttaatgcacgtaacttgtttgttgaaatgccgcaattaattgctgaatttgcgcgtgcctttttgaatcctgtttctctatgtgtcagcatttttggtcgaagtggtttttcaaacttctgagtcggcagctttacttaccagttttagagattctaccatttgtccaacaatccctgttttgcttgtaagatttgtgaaagtcagagatgtcttagtcttcttgttaataattgatacgtttcttgtttactaggtgggaattgtgaagttgtgagcaaaaggaaccaaaa

SEQ ID NO: 521 - DNA, 3000 bp, Arabidopsis thaliana
aagttcactcctgtgtgtatttctgtcatggccattttacaattcactgcttgtttgcatatgttgttaccagacaatataatctcccgcttttttatggctatagcttccagatggagacctccgggagaagattgagaaacttgcttcttctctaaagtttcctttgaagaagctgtttgttgtcgatggatctacaaggtcaagccatagcaatgtgagaagcttgagatctcttcctacctactttactctagtttaccattagaagcttacgtatcttgttacatcatacaggcttacatgtatggtttctttaagaacaaaaggattgttctttatgatacgttgattcagcaggtactgtgactcttgatgcttcaaacgagctatactcacatttctgtttctggttctgaaacataacataatcttctattgtgcagtgcaagaatgaggatgaaattgtggcggttattgcacacgagcttggacattggaaactgaatcacactacatactcgttcattgcagttcaagtgaggctcaaccgacagttcaaaaacttactcacatctacatttcacttaagaaatcatgtcttatgaccctctctcaatgttttgcttgcagatccttgccttcttacaatttggaggatacactcttgtcagaaactccactgatctcttcaggagtttcggatttgatacacagcctgttctcattggtttgatcatatttcaggtttgttatttttgccttttgacactaatctaatgaatcaaggatggattaagaaaaaaaaactctaaacctttggttatatctcctgtctgattatcacagcacactgtaataccactgcaacatctagtaagctttggcctgaacctcgttagtcgagcgtttgagtttcaggtaccatcttacaatccctcaagatccaaccatagtttctttattgcaatggcagcctcatctactaatctgagttaacgttccttttgcaggctgatgcttttgctgtgaagcttggctatgcaaaagatcttcgtcctgctctagtgaaactacaggtcagagaagataacaacagaacacaaactgttacctcaatttgtgtcacacacttaaatggattttttgttgggattttgcaggaagagaacttatcagcaatgaacactgatccattgtactcagcttatcactactcacatcctcctcttgttgaaaggcttcgagccattgatggagaagacaagaagacagattaagtccgcttaactcgtctcttgtacgggttgatgtcttttaggtgacaggtcgaaacaaaacaaaaaaaagtgtaaaaccatataggcagaggcctcttttgtttgttttttacttttacagtgggttttgcctagttactactagtttttgagtttcttaaaagtggaatcactcgcacggttcgatatgatcatttctgattcgtcttcttttattaaaatgaggagaatctaacgtatatgaatcattcttgttttgaaagtgatataggttatgattggtgttactaccacatgttagaaaatcgtgtaaaagtagtactaaattgaacatgggattcagcgatacagaattattgaacaaggcagaattgtttttatgagaatgatacatttcttgctatgatggtgcaataatgggtttctcttttcgcccaaaccttatccttttttctttatcatattctcataattacattaccctttaaagcatcccttctaaattctggattagtctgtataatatcattcattagttcaccggtttataaaaatcagaaagtttataagtttcaaaattttgctttggtgaaaagatcattcatatggttccaatttccaaaccattaatttaaattttagctcatagttgtatctcttcgtctcgatatggacaagggatcccaaagtacattataaatataaaaactatgggcatgggtcttttgacgcatacaaatttaaaacaacttaagctttagcctttgttctacctaatttagtaaattattagtataaactataaaggatctattatattatttaatacaagaatgaagaaaactatattatctactatattcgctctttcttttttttgtcaaaatggaatgctgatctggccactctacataactttcatctagcctctcatccttatctagataaacaaaatatgtggccctttgataggaaaaaatttcattcaaaaaatgcaaaggcagaataatttaattttacaaacgaatgttattaatgcagtctatagtctcttcggtataataaaagtgattccttttctccaaaaactattttgaatgatattaaagctcttaaatagcaatacactaaaaacgtagcttcattaatcaaaactcggatctaaatgtgtacttagtgaatgatattagtagagaatcatatccccaacaccgttatctctccgtcatctcatcgtttgtttttattacaaacaaaccccctcgggatcacgtaggtcccactatttttcctcttaactaaaagggtaataccgtcatttaccacacctctcgccgtcactaacacggagagagaaagaatcagacagctcatcccaagcacacacactcatatcagaaaatacacagacacaacacaacactgagagagagcttttcttttaaattccttcaatttttttttgttgttgtaaagaataataatttattcgattgaatttgtttattcgtgtctttgtttttactcaatcccctgtttccggttctgttcgattcttctctgtctctgttttgtttttcgtcattttgcctaaagccacatgcaacagtgattaactgaatttttattatccatatccattttgattcgccggaaagtttattcttttccggcgacaaatgcgaaagattcgaaaacccattttaaccaaatcaattct

SEQ ID NO: 522 - DNA, 3000 bp, Arabidopsis thaliana
taattatgggatcatgagtatttctcgggaatgtgtttattcgcaagtctattctctaacctcagtaaataatgagtggaagtttagttaaggccaaatagtctaaaatatattatttgtagttttgtacacagccaggattgaatcttaagagactctttaagtctaaaattacaatcagatcctagaccactttctatttgcatgaacgtaaccggatactgattttttaaatgttttctttggttcaaaatcgccactatctttgacaaaaacattctcgaataggattcaaacctaagagcctttcaaattcgttcttaattatgtcatcatctttagttctgctcccatctctcatcggtctcaagaaccactcctagtcatttaagtactacgttttatacacattacatatacatacatttacacaactaggaattgagtagggaacaaagtttcaactttcaactaatagggtaagccttctggtacatggaaaccaaccaaccaatctactagtttttatgagttcaaagatcgatcttaaccggatatctatggatgcaatgttcccaaggattgttaaccgagggctcgacattgcgaagagccacccaaaccgcgctgttacacttaaacccgctaccaaaagcaatctgccaaactctgtttcctttcctcattcttcctttagcttccgtgtaagccaattcataccatatagagctagaggaagtgtttccaaatctatgcaaagtcattctagacgcctcaacatgttttggagaaagctttaaactcttctctagctcatcaatcacggctctacctcccgcgtgaatacagaaatgatctaaagcaagcttgaaatccggtatgtaaggcttcttcttcttgtcattgaacaatctcttagcaacaaaagtcgcaaagaacagaatctgctcgcttataggaagaaccagaggacccaaagaagtgatattcgtctttaaagcttctccagctatagccataagatctttagacaaagaaactccggttttcaaacactcatcttgttcttgatacacacaattgaatgcgttctcatcagatcctttatgagtcctgaccgtatgaacaagcttatacttggatcgttttcgatccaaaggcttgttcgaaagcagaaccgcggaaccaccaactctaaacaagcaattagggatcaacattgctttcttgttaccaaaataccaattctgagtgatgttctcagtactaaccacaagagcaaaagtgttcctatggatttgtaacatatcactagctagatctaccgcgataacaccagcactacatcccattcctccaaggttaaagctcttaatgtttcctctaagcttatacttgttaacaatcatggcggataaagaaggcgtagggttaaacaaactacaattcacaacaagaacaccaatctccctaggattgatttttgtattctcgaaaagattgtcgagtgcaccgaagattacctgctccgcttcttcacgcgctgcagccatagtaggacgcggagggatagagtgaatagaatccggtaaataagtctcttcaccgagaccagagcgaatcaagatcttcctctggaactcaagagaagtttcgctgaaatcttgaatcaaactagagttgttcatgaatttctggtagctaactttttgactcgaaggcgggaggtagcaagagtaatctagaaggtagatggatctaggtcgagacatgaagaagacaatggatccgacaatggcgagagtaatgacgaagatgaatccggtggaattgtaatagagctgaagatggtttaggcttaacaatgagacattcatgaacaaaacagccattagagggaggaacatgagtttaaaaaagtgagtgatcagatagtgataaccaagcttgacgtagttttgggtccggatctgtacaggtcctccattagcatccatggacagtttctaaagcagaatctttgatatttttgttgatgatactgatgagaaactgaatctgggtttgtgtgcgtatatatagatactgtgagagagatagagaagaaatcgtaaggggatgtgtttatagacaccattttttcttctgcaggttgggtgggagtttgatataactaaaaaacagagaagagtcgccattgatgtatttggcgtcatgtgtatcggccaactaatggaagatatcaagaggaaaagtgatgaagaagcttctggtttttcagatttttatgggaaaaaaacagagagagtagatttgaatcgaatttcaaattttcaaatttcaagaaaaaaaggaatcttaatgataatggacgttgatatgggcttggggtttaggcccaattgtttttcttttgatcttgtgtaaatctatgtatatctttggagatcaatcacaactcaaagaattggcccattatgatgtaacctaagtttgactattttactattttcttcctcaatttttttaagatcccaaagaaaaaatatggtattattgtccaataaacatgtcggaagcaccaacattatatgctaaaacatttatttaactaatttcgattaccaacggcgtacgatttaatgcaaatccagctatattacagatcctcattattcttacaaaattctatttcaataaaaaccaaattttagttagactatcattaacatactatacattaatatgtactcgttcggtggcattctcgtaataaacactaatcgcatgccttaaataggaaacactctctcaagtctcacaattctacccgttgagctctctcattttatttttttgttaaagctctcatcagtcatcatcgtcttttctcttttgtttgtttgctcctaacgtttctctttcttggaacaatctccagcaaaccaaactaatccgtctgagagaagtagttttgactttctctactccgtgatcgcg

SEQ ID NO: 523 - DNA, 3000 bp, Arabidopsis thaliana
atgatttttgaaggaggaccagtacctcgattccggagtctccgattcggaaacaggtttcgccgttgatttgggcttcacagggaaaacctttgacacttgatggtcattcagccgaacacgaagctcttcctccattattctagagtacaagcagagagctagcttgaagaagaacgcagctaacagagagagagaaggaggctggtttagggtttaagcagagaatggcgaagaagacatttgataagtaagtatccaaatgaagtttttgggcctcgtttattatgttattgggcctaccaatttgttggcatctgaagcccttacttaaccttcgtatttaacttggacaaactaaacgaatttatctcttctctcctttcctttcttcttctgatttttttagtttctcaatccttatttctctgaaaagaaaaaccgaattcctcgattcatccacaaggaaaggtgattcatcaatcttgtgcttaacacataatgcatgtggattgatttatatcaggcaaattggagaatgatcaagtaaggaagaagttttgtatactgaaagaaccacagagtacgaaactattcatcatgtatatccagaagtaatgcgcaaaagagcaacttacaatgttacaatcaaagacacatggatgctatacgccaacggagacatttctgcttcaatggtttgattccttgatgctatagggttcaaatcgaatccctggatgcatacaatccttcccaacaaaatatgctgcttgtatttattcatatctctctctctagtatcctattttcccataactcttttactcgcttcaggtcgttggaaatcatgtccatgctttaacatcattcctgcgacttgattaaccttatgctcctgtccatgcgttgctgcgtatactctaagcagaatacaaagcgtcttcttggaccggcttattttaaagctttccatttcagagaggacgttttccatctctttaaaacgcttttgagatccatacatgatcattaagccatggaacatagacctgctcattttccatccagcagagtttgcacgctgcacgaatttggcaagcttatcaaccgcattgcacctgaagtaactagccactattgatctcataataccatctgtctctatctggagtccttttgtaatagcctggtctatgaaattctccatggcatgtagattatcatccttagcatagacctgcatcaagagcaaatacaaccaaggcttgtaacttttcttggggataagtttggataaagtcttgatttttctgatcctatccttgtgacaactcctgtagtatgcgcaaatcatggactcgattaacttaatctcattcctgtcaacgtgacgcttgacggcttgatacatgtcctccatccgtagcagatttcccgagtttgcataccctctgagcatcagcaaataggtggcaagcgtaggcttaacaaggccgttcttcatggagtggaaagttgcttccatcttatcccaatcccaagcatagatgtacccagcaatcaagttgttgtaggtgctggaatcgggaaggatattgagttgttgaagctgtaggaatactgattccatccgctcaaccataatcaaacggccataaagagaaatgaggatgttgtaagtagagacagatggagtagaagaggagggtccgtcttgttgagaattgaagtcaaggaagagctgctcgcaatgatgagacaaaccgttgcagaggtaagcacccatcaaagcattgtagacggaggtggtcttgtttgcagactcgtgaaacaaggaaagggccaaatcgacattcttcagtctaccagaaatggtaatgcccttagcgtattcatcagcagtcataggcaacccatcgcatagtgccttgtttcttctccagtcgaacacctgcaaagcaacaacatcaaacatgacggaaaaaaggctttttcttttgtggttgtgaaattcgaagacaaaaaagatgtatgtataccagttgggacaaaacgggccatggacgtaactgcctaaggagctcaacaaacgcagctccttggattttgttcctctccaaaacggaggcaactttaccggaatcattacggaagcgcaacaattggtttttcaatcccgaagcatcatcatcgcccccggattggtggaagggagacctggagagggtaaagcagaatggggtcagagtcttcaaggttgaagaagagccacgggaaaggcagagcagatcagatatctgggaaatcagtgagattctccacatgcgcttcttcatggagactaggaggagcaattgagatgctctctctcaaagtcaagggtgatgattcggccctttcggttctatttgggccttttcgtcatttctcggcccatttgaaatgtccatttatttttgttggtttgaagtcaaacggtggaatatagaatttcttagaatacacacttaacacagattcttttcttcgcatgttccggcggccatcacgtgtagattagtaattgtgagcagcagagctatgataagactaagacacgtttggatttattagataatgcaattaggcttgttattaaatacgaaacagaaacatgagtaggtaagacctcttcaggatccaatcaagaattttaaatattatcatctctcaccagattaccactattgattgaatagtatgaaaatgaaacaaaaagtgaaaggaaagttctcgtgcaacttcgtggatgagactcaattaggttcatgacatgttttgaccgtttcaagtaaatcaagtaaataacacaatcaataatacacttaagagtatatatatatttaactaatgaccaaaatattactagtgggtcaatgagtgtaagaaacaaagagagagagagagagagtgttatgttatgtctttattgtcaattagtaattttcttcgaattag

SEQ ID NO: 524 - DNA, 3000 bp, Arabidopsis thaliana
tatctgagatctttaagcaaggaacaaaacaagaacaagtcgatcaccaaagtcactagaattctccaatctactttaacagtacgatatattcgttgcagcttacatgtcttttgactatatgattctccagagtcatgactttagaagcagtaaattttactcacataaaagtttctaccgtaaattaagattcaattccttctagaaaaataaggcatattcaagaagatgttccataggtagtaatgtaataattatcataccaggatgacgccagaacttttcgttggtcacctctcgaataagacgttccacagatgtatcctgatattgggtactacttgtggctggcttcttgaaagatctttggctgtaagatacttttctactagatgaatgaccgctcttgggctgccgtatattagccggctgcttccaagaagcctgccttgatacagatgttcccatcccttcagcagaaggttcttcatccctgttgagcctcctaggtttaccaagtaaacctgaatatgattccccattactttcggtcttctgttcagcagattctgaatgtataccgccagtagaaggaaaatcaactgattttagattttgatggctttggctttggctttctcctccatgctcagcaggtggattaactgcactggagcgtgtagggacagcctgtgcaaagttctgtctcctaggtgtagatgtattaacagtacctgcttgcttaacatcttccaaattaagaaacctagtctgcctatttcgtttctttcccaacattgcctctttatgttgatccatctttctcttcactgtagtattagcacatttaactgcataacttgcttcaactcctttaacttctctctgcttcaccatcaaacctggttcttgtagctcatctctaacactgccttcaccaccagtttctatcattcccttgtagtcagaaagatcttgtgtattctccttggcactagcatcagaatccatcacttcaccttcttatctgtcataatctccacaagtattagcgtttgcagatacaataacattctttggttgattcaaattaacatttatcatttccatcagcatctatagaaacttcactaagatcaagtaacaataaaagaatcaaatgacgtatctcctctgaactacagaagtttctgcagagaaagcttaaacctcaaaatcgaaactaagcatagtgatcaaaacattgattcagcgaccatgaatatagaacagatgattataaatggcgcaaacacgcatttgttattcaagcaaagttcaagatcgagcaaacgaaccggtaacagagtcggcgaacggcggcggcgagttttagttagggtctaaaaagaatgtgttacgtgagcacaatcgtaatctcactctactccggcaaagtttgtactgtgccgagtacgaaattacagttctaagatacgaattcgtcttccgatgacgccggcgacggggaccggagattttattaaaacttaaaactattcttcgatatcggaggggagaggaatctggtggcttagagactatgcgactttgtaagagattgaacttggaccgttggattaaggcttacgttagataatctgacggtatttaaaacatgtttgcttgtttagcttatgatccgatgtgtaagagcaaatttgtttagcttatgataaaccctttgatgcttatatagggggagaaagagagagaaagagcaaaaaaaatcgtatttgttttaaagttctttttgtaatacttctttttaaaaattgtatgtgatgtttaaagttttcacacaccaatcacgaattattattattattatttttaattatagtactattaattatctacttaaacaagatttaaccagtatgaaaacaatctgtagaatataaattgttaaaataattaaaaaaatatatttaattttgcattaaaaattgaaaacctcatctattttaaaacaaaaaaaaattccaaaaacattaaaaaaatacataaaaaaaagcaaaaaaaaaaaagcagagggtgtattttaggttagcaaaaggttttagaagatcatttacggcgaatcaaaagatatgacaacatattattgtgggataaaaaaaattattgtgggctaaaagatttgaagtacacgaatttcatttatgtcaaaacggtgttgtaacgtagaacgtagttgttcattctttagctatcaaaattcaaaagatattgagatcgaaaagacgaaaacatacgtataatatattagggatatattattgtagattacctaaaagatttaaggaagcgaattttcactcatctcaaaacgattttgtaacgtggttgtcattctttagctaaacatgatcttttaaatacatttttttttcttttattgttgtattgattccaccattttgattaaagtttttatcttgactaaaaacatttctataagaattcaagaggtgttttaaaaataaagtatatcttgacccacaaataaaaacaagaatttgggtacacattattttccaatttgtataatcatcatatgtccgaccatattaactagtcaagacgttagacttcattcataatacgaattgggtgctagtttggttaaatgcattttatgactacgcattttattcacacaacacaacagaacacaacgtgaaatatacgagaaagacaaatcacaaatctaataatatttgagtttttgacgaggtcaagaaaagtattttaggtccgtcccatcataattattgtaacttgtttgacttttctccaataaacaaaccaacccaaacatacgacatatctcctctctttgataatcgccattaacaaaccaaacctcacggagtcttctcctttttaaaagaagagtctctcttcataatcatatgatctctctctctttccagtttcctctaagcttttctc

SEQ ID NO: 525 - DNA, 3000 bp, Arabidopsis thaliana
aatcctaattgcctttataattgcagatatgtcaaagaatcaagcaacgacgaaagagagcacacagagaagttcatggagtatcaggtttcataatcttgtttcacagtttccacaatgatttttgtttctcactgttccttccctcttaatcaatagatatctaattttccaatgtggtccctaaagaagaactaagaacccaaatctatctaaagccaataagccattagtgaaaccagaagttgcagaaggtacccgttttgttaagagtccattaaggtgctagaatcgtatgtggtctttgcttcctcagagattcgaagatgtgaagatcatatctgaaactgagatacacgtacgagatcactattaaagccaatattatagagacaagtcacagatactatctgatgacatgtacttcgattcttacctaaaatgtaatgacatgttactttgtttctacaagattgacaattcctaagcacagaagctatgaaaagttcatgatcttttcgtaaagattctctttctttgtgactgatctattatagaaggttcataaactacaaactactaagcctcatgtaccagtgaagatccgacatgaaattcctgtaaagacttcataaataccatctgttgatcatttctctaaatacttccggaaaaacagttaccaaacttgcatgaaatttgaaaaggggaactgaccatcttcgtgaggcaggcggtgacaatattcatcaataatccaaagactctggctatgaggatttgtatctctgtgagactgtgactgttttcaagagacagggacaacaaaattataacttcatagtgtgtactgtgtacactctcgctaaattggatcgagttctctggcctgtaaaatctaccccaatataagacagaaaaatggcaaaccctaacaagttcaatggttcagtggagacactaagcaggttccacagttcagaagagaagctaggtaataatcccaaagtttgctaggccaccaagatttggattcaaaatcattaaatccttatgaaaggcgtttaagaatataatgaaagcatagaaactaaaaaactgcacttctgttcctttagaatttgtacaacctaaatctgaacttgtgcatcaatctgcacagcaaaaaacgatcaggaaaacggcaggagcagctgcaacatgaacacggaaacttgcagggggaaaaatcttagattgatgatgatgttacaggagaagaaaattcaaaatcatataacaaaaatccaaagttaagtaaagtagaaagtgtttacatcaacggaactgatggtagataaagaggtttttggttgctaagctaaaaccaagactgctcacacatatatcatacaaatgaagtggtgccaagtatgtttattgtttgtttatgatgctccagatactgttacatgtctcgtatgccgtcatcttatttgtctcgaattgaaacttctcaattagcctcttttcacgatctaccatatctaatatgattttcaaaatcaaggattcaaaacacctaaggataaaaagtgaacaatatatatgattaagaaaacgttgatagaatagagtgatgatgaaagaacaggatacagcctgagatctttgatggatcatcaatgtccggtataacgttcgtgacagaagcatacattgatagctttttcctgtagataaaaagagggaacaatgagaaaacaaatgtaacgagcattcataacaagcaactgcagtagtgaggtttgtggatcttactcagctctcaagtcgtccctcacttttctctttgtagattgcttatgttcatctatcgatgacaattgagcattcaggtccttgagttcatcagcgactagtgtattgacaattaaaaaaccaaaagattaattttttcatgtcactgaatcaacaactaggatattttcactcaaaaacaaacaatacttatctaagctcgtcttttagcttgaactcccgttccatctcttcgtcaagctctttctgaagacgttcaatttcatcttcagccgcaatatctgaatatgcttcctcagttttcttcttacaagcatagagtttcgtcttacaatctgcgtccaaaccaaaaaaattcctcgctcaatccagctaaagccacattatttatctagtaaattatctagagaaccaaatcggaaaaacaaaactgaccttcaatagagccttgtatctgattgaaatcctcatggcaagcaaaattgagagctttgaactgctcagaactttgagatataatatcaaaaccattcttaacattcaataagttgatcaaatcgtctccataagacatgagatcttcaatatcgaaattctccgacgcatttcccatttctgctgcggaaaattgaaaaatcaactatctagcagcaaaagccctagctccacacctcaaaaccctcaccagaaaaatcgtagatttctgataccaccaagtaagtacgtgatattctggaatctggagagaggagggagatatgaagaggaaagatctgaattttgatttttgatttttttattccaaaagtaagtttaatttgacataattaactgctaaaaatatatggacgctaatatgggccaagcccattagttttcactttccataatgggctaacaaaatttatgaccaataagactcatgtttaggctaaatcatagcggtcttcatcattttgtccactattttgttttcttttggtcgaagatattgtcaagtattaattatgcaattacgtgaaatcatgagagtcatctcctccacacatatagcccaaaaagaccttgactttgaacatttcgactctttcgtcgttgatagcataagaacatgtccatatttgaaacttaaactcaatgctctctcttactagttacttcatacaatcaaagtcaaaaagctcaagataccactactca

SEQ ID NO: 526 - DNA, 3000 bp, Arabidopsis thaliana
ctgagactaagtaatgatacacaattatttaacttcattgaggttttgacatggtgaactttgattgtgttattgaagaattggatgaaaagacaaaggaaatgctgagagtgattgatgaggatgctgattcttttgcggcacgagctgagatgtattacaagaaaaggcccgagcttatagctatggtggaagaattctaccgttcacatcgctccttggccgagaggtacgacttgttgagaccctcttctgtgcataaacatggctcagactcggagagtcatgagaaatcatcaacttgtgatgagtcttcttggtctgaggcttgtgagactcatgaggagtatgcggagtctgaaatagataacggtgaaagcaaatgggtcgatgaaagtgaaattgatggcattgttgaggaaatagaaccatcggaagtcgtttacagtgaaggtaatggaaattctgagatgatgaagatagagatagagaggctgagagaggagaataaggtttacagtgaaatggtgagagagaaagatgaagagaagagagaagctataaggcaaatgagtgtagcaatacaaatgcttaaagaagagaactcagagcttaagaaacgtgttaccaatactgttgttgcaaggcgtaataaggaaggtggtgattctcagaggaagcaacagatgtggaagccatttgagtttaagaagattaagcttgaagggttatgggggaaaggctttggcaattgggctctcccaaacacagattctacttccaaagagctcatgactctttagaggagacagagaggtccgagtgatcaagaacagaaactgaggaactttctctaaatatctttgtactctgtgataggtagggtatactctcaactagttagcgtaaggtatatcataggattgtagttatacctaagtccatggatgtttgttacattttctattgttcgtttcttgtttaaatataattgtctttcttttgaaatcaattgttttgttctttaatatctgtaagtttgttttcttttactttatgtgtgtaataaatggtgataagaagttgttgtttaaaaggtttgaccattattttagattttcataatgttcttctatatgattgtggttttgtcgaatgatattcttttatatgatcataagtctgaagacttttgggtctcactatgaggataagtaaatttcccaaagatctgcaaatttgaaatgccagagactggtgagatgtagaatctaactttgtttttacataagcacgttatctactatctacagattggatatagattaatctaacaacgtatacatattttagtagactaatgaatacttgattgatatgtcaaactttttcattgacttctttcatgaaatgcaatagaaatattatcatttactcacagagtaacagtggagattcttttaatacgttttcatgctaaattaagcggccgagtggttttttcttcttaattactactacactattatcgtttatcaatgactaattcacacaaacatgcacaaaaaccagaaaacaagtggggtcaaaacgtaaactaaataaagtcagcggccttctttgtgaaatttgatgtaagaatcggagctgatgtggttatttatttccgaatggcaaggacagtctgtcatatttatgtttttgccactagtatttccttatatttacgacactctacccttatttcagtgtcctctactcgttgtcactgaaaaatgaaaatgacctctcgtgtatggatataaattctacggtcaactagtatagtcgtatttatttctataactatttctcgatttacttacttttaatttttttttttacaaatctagaattggtcattggattctccgttccaaaaataaataatatgttacattaatataacacatattattattcacttcatcacttgttacaaataggattggattgattttaatttagttgtatggtgcgaaaacgataaaaatgtttatattcaatttaagttaaaaatgacagtttgcatttggagttggtttggctagattgaaatgtccaaaccctcttttcaatggtgtaatatattattgtctaaagctaaaatatatatattatataaaataattaatatggaaatttatagccgtgtccatgtgtattgtcaaatactcaaatttcaactgctcaaaagaaaaaaaaggtttttctttttgtgtttgtaactgtgtatgtttgatttggacctttaaacaaacctacactttttattattaataaagaattaaatatataaaaattttagtgataaaaatattaggacatatatctatcactactttaacgtcagatgatcatatccattataaggaggaattgataaaaaaaaatattagaataaaggtagactaactttaacaaacgatatccaacataaacaaaatactcacttttctttaaaccaaacgacaataaaaatccaaaaaaaaactaaacataaactaacattttgagttttaatgcagaagactgaagaaatgacagctatttaatttaaacataacaaaaaaaatagtcagcttattcacacactccatattaaaacaaaaacgcggataaaatggtaaattcggcatgacaacacatccataatcagacaaaacaatccgaaagtgttcccctggcatcccacaggctcgccttcttgtttaattgaacagctgttttaatggcaatatcgtaaatttagtaataacgacgagcccagatttagtccgtattttaatttaaccactttgtcacccattagttagtagttctctcatttttttttcttattattattattttttccaaaaaaaagaaagtaaataaataaatattcaggaagaaaaagcctgtagagagagaagaagaagaagaagaagaagaagacgacgaagtcgagagaaagaaata

SEQ ID NO: 527 - DNA, 3000 bp, Arabidopsis thaliana
ctaaaaaagatgatcaaaggaggaggaggaaagtcttctggttactcagcagatttgatggtttgtttcccatcaagagcacatttgtctttaccttctaaatccatttctagcccttcttcttcctttaaccgccgtcaaaatgctcctcaccaccgtcgtagcatcagtaagctctctagcagcggcggtggagtacgtcagaatcgcggtggcggaagggaggtagttgaagaacctacgtcgccgaaagtcacgtgtgctggtcagatcaaagtgcggtcaagtaaacgcgatggtggaggcaagaattggcagtctttgatggcggagatagagaagatacatagaagcaagtcggagagtaagttctttgggattaagagagatgtcatgggatttttgacttgcctccgcgacttcgattttcgatgttttggtgcgtttcctccggttgatataatctctgatgatgaagaagaagacgaggaagaggaagaggaggatgaagaagaagatgaagatgaaagttcagggacagttttctctaaatggcttatggttttacacgaaaagcaaaacaatgaagagtgtgtcgacggaaaggaaaacgttttttcggatgtagaaactgcggtcccgccgccgaacgcgttgttgctgatgcggtgtagatctgcaccggttaagaattggtcagaggagaagaaagaagaaacagaggaaggtgataacagagtaaaacagagcggagaagaagaagaagaagagaaggacagagtgggaaataagaaggatctgagatcattaatggaggaagagaagaagatgaatttggtagtgatgaattacgacacaaactattacaaactctctaatgatatcgcaaaggaaacttgggttgtcggtggtattcaagatcctctgtttcgtagtcgaagctggaagaagtgatctttgttaatccttttgtaaaattaaaacttgtgaattttaagtatctttcttataataatactattgtgaaaatttgagactgattggttttcgtgtaacaaacaaatacgattgcttaatgggccaattatacaaacagtaagtggaaaagacatgcacatgatatgcttcaagcccgagtatatattgacccaaatacaaaatctgattacttaagaacaagactactaatcgacgcaagtataagctttagtgcttgacgttgacacagaatcaactgatgatgctttggatggtgacgcgaagagaggaaattgcgaggaagtaactaaggaaagtcataataagcaactacctggctaaaaagtgagtagcttgtgtcagaagctatcgttttcgtggtctttcctaatttagaaaccaaattaatgatattcctagtcatgcttatggcttgactcagattatactaaccggaattagaaacttgttgacttaaggaggaccacttctagagcctataatcagctatactacggtctgtctaataggatcgatgatcataataaggaatgttcaataatttccgcgaagtttccgaaaataaagatgatatgtatgattgtatgaacatataatttgttacacgaaatcaaattcctttgacgtttttacattttttttttttttttttttgttttgtttttgttcgtttgtataagcttaacaaagataacatacaaattacaaaagataaattatacttaaccatcgtaataaactacaagcgatgaatttcagttttgaccagcgattcttgcgaatatatatatatatatagctatattttataaatatttagttaatattatttaattactaaatactaaatatataactatattactatattgttggatctaaccaaaaaattctatcaattatacacctggaaaatagcaacaacaatatttgaccaaaagaaagtgcagtatcaatatttgagattttgtttgttgtaagcgtttatggttttaccaatttctcaccttttggtatagtcgaaagaaaaaaatattgctagctacacaaagtatcagacaatatatggtcgccggagtaaatttatcagtgtactggaattgtatgtttattgtgttaactacatgacgtgttataattcagatatgtggccatgcaatatatctacttcatgtaactgatgatataataatatacttgtcatgtgtaatcatgcattgtccgtgtacgtagcaatcttttttttctagtcgaaatacttttgaagtaaaagttgttgtcattttaaaatctaacaaaaacaatatttttattttctacaagatattttatttaaaatagtttgaatagctgatgttaaaaagcgaatttttttgattaaaacttaaaattcacaggttctatatatatataaatactttaaaatcttcaagtgaagaaggtttaattggtaaatttatttctttttattttatttagagtgattatttcactaatatgtggacaaaaaagattaacaactttacaaagatatgcttttgttcttaaaataaaatacgaatattaaaatattcaaatttctttttttatttgattgaaaacgtccacttataactttaaataatttgggtaatctgattcagagatatatgccaaaaatagtaagaatgagaaaatctagcccatttaatcgcatagtctattcaattcagttgacttaataaaaagttacaaaaacatttatcttaatcacttactaaagaaaagaaaagaaaaaaaaacacacagaaattttataagaacttctgttaacaaaacaaaccttaacactcccttcattctctttgctctctccctttctccattagtgagctcgtctctcatcaaacaccatgaaaaacaattaaaaaaccttatattctgacaaataaaatacatattttgttctgtttctccttagtctctgtgtgatttttgtagaataaacgagaaacagagata

SEQ ID NO: 528 - DNA, 3000 bp, Arabidopsis thaliana
ttgtatttgagcgatccatccggattcaacaaatatgtgtcgggatgaaagtgggagaagtgactctgtttttccatggatatatagatgagatgaaaccatgagacttgttgaaaacgttcaacaatatgttgtcaattaaaagataaaaattaattaataaaaatatcatatatatatatacacatattctttttaagtttttgcttttggttttggtcggaaatacacttttttctttatatttccagtttacgtaattcatccaaaagtagaacatcagagtaaagtgactatatatacacatatgcattacgaatatttgatggattcatttaatttgtattttaaacaaaataacaacaaaatgtaacaatatcatttgagttaaatgcttatgtcgatttccttgatccacaacttctcttaacatgtttttacctttcatatttctccaactcaatcgttttggaaatcctgatggaatattttagaaaacaatcaacagctaaatataattacccggagatttttaaaagcatactcactgattccttattcagtaagttggaaaccacattcctgggcatgatcgataatagtgctaaatcggcaagggttgaagaagatgacaaagaaaaatgcatattaagaatgaaaaaagccggtgagatctgaaggaaacattagtatcaccaaatattataaaataaatttggtttttgacgttttgtgggttggatgcaaatcatgtatttcttgtagtgatatataaatgaaattaacgattaaatgaaaaatcaataaaaattagcaaatcaatttaaccgagtcaaagttagggctttgtttagcattttattacaacaaagaatatttttgacatttttccctatatatatatatatatatatatatatatttgtgtcaaaactacacacagatctataacaacatagttaatgaccagtttgagactcaatctaacctctaaaattcatcaatttgagtaaggttaccagaattttattgtaaagtatttttgctctcgaactgtcatatgaacgcattaccaagtaaaattgtctaaaatatgtcattgttggttgccttaaagtccctggtaatttactaacagcaagttctttagtaaagatatggacgcaaatttaatcaaaaaatacaaagttaatcaagagttagtagatagagttatttacatatattttctgtttgaataaactaatttaaatatgtatatatttacatatattacaaaaaataatgttaaagagtaaatcaccaaacttgctgttagtaaaatagataatagatgggcgtccataatatattagattaggttacactcaatttagaacgtgtgaaaaattaattgaacaatgaaaatcaaaaatgaaaagtaaatttaaagttttatcaaaaaccaaataataccatttaactatttgtagaaaattgaacagtaacttccaattattttttcagctttttatacaaatttattgtggtgttcatgttttaatgccctaactgagttttatactttgtggaataccctcttctaatatatatatagcttgtaatatagtttttcaatttaattaacattaggtaaataaaaaatttgtgagagaaaggaacattcaagaagatattatttttattagtaatgtttttatatagaagcatatatatttactaacatacttgaattagtttcataattgttttagatagattaatgataacaccaattataaattttgacattttgtatattttgctgacatctatatcttacacttatcttaaccaaaaaaaataaaaaaaattaagaaaaatattcaaaaaatatatttgtaagggtctctatttattatatcatgaattatattgaacttggttatccttattctaacctaataatctttctaaaatataatcaattaattgaaatgtgttgtgatttcatgaattacagttttgccacatggcatgctctcctaagaatattaaaattttctacattaacattaacaaattttatattttatatttatgataggataaagaactctaatatttttttgaataatattaacaaacaacaaaaataacaaaataaggtaaatattttgttaacaaatttcatattttttatttttgatacgataaagaacttttacttttttctttgaatatattaacaacaacaaaataaatagaatgaggttactagtttaatatattaataaaataaaaaaattgaatatatagaaaataaaaaatcttacttattatatatactcctttttgataagggtaaggactttttaaaatatatatattaaaaaatttacactggagaaatgacggcatcttatattttaattaaaacatattacgattatataagttaaatctaactttatataataaaatagtattaattttaactaattaaacttatattttgggtagacatatgtttttaatatctctaatcaaatattagtgtatcctccttttttaccatcatattttttctaccgtattatgtttccttctaaatccgtaaaattagactcataaaacagaccaaacactccagagtccaggctctctctatctctccccggtacggtcggattctacgttatccaatcacactctatttttcaccgcagttaaagaaaaaaacacaaagtgaagtaaactcattactagtttggtttctcaacgaatccttacttaatcactctgatcaaataccattaattatcaccgatcctctgattaatcactctttaatcgtctctttatttctctctctctctcttcttcttcttcttcttcctccagagagcaccttatgctgattcctctccttttcttcctcaactcataaacccgatcggccgattccttcacaattatccttaaaattttcgattttgattattgggtttctctctgatc

SEQ ID NO: 529 - DNA, 3000 bp, Arabidopsis thaliana
ttaaaatcagatgagacttgtgtataaatactttgagatctgtgttctctttcgttcactccaaagagcatcctattaagttgctaaagagagagacgccaatggctgtaaagcaaaaggtctgtgttactggtgcaggagggtttattgcttcatggctcgtcaagtttcttctctctcgtggctacactgtccatggaaccgttcgagatccttgtaagggataagatagaaaacaaatcctctcttttttgtgaacttttgaatattctctgtttcttgagtttgaaaaagttgcatgcattgatcccattgttctcaggtgatgaaaagaatgaccatttgaggaaactggataatgcttcaaaaaatctgaaacttttcaaggcagatttgtttgatgatgaaggtcttttctcagccattgatggttgctctggcgttttccatatcgcttctcctgtgccttttgaaggagttcctctcacagaggcaagttcttacatagattcttcttttgtttgtttcttgaatcactaacaaagtctttaaaacattcaggaagaactgattaaaccagctctcactggcaccaagaatgttctagaagcatgcacagaaaccaaagtgcagaaagttgtggttgtatcatcaatcgctgcagttgtttacaatccaaaatggcctcaagatgttgctaaggacgaggattgttggtcagacactcaataccttcactcacttgaggtaatattgtatctttgaagctaccatgttggtcagttgtctctgtgttatacatatacaccaagacagtaatagaattgagtgtttaatgtgatgcaaaaaatctgaggatctcagggttattggcgttattactatcttgccaaaacattaacggaacgtgaagctttagagtggagtaagagaaactttgctgatgttgttacgctctgtccgtctgtcattataggccctaggcttcaatccacgcttaactctagtagtttgggacttctcaagttcataaaaggtgatgtaaacatataatgtgtgttctcttacctcctattgcatattttggttaagtgattgattcattcttgataatttgatgaattggtgtgtctcttcttaggtggtataaagtccttgttgagcgatgaactgtatcttgtggatgtgcgtgatgttgcggatgcgcttttgttggtgtatgaaaatcgagaagcaacaggaagatacatatgtaattctcattcactttacactgattctcttatggagaagctcaagaatatgtatcctaaacgcaacttccctgaaaggtaagaagagtaagaacaaacgcttgatttcaaactttgagatttcggtctgatctgatggaatgtttattggcagtttcacggaggtaaaagagaaggaagtgaggcctctaagtgcagagaagttgaaaaacttggggtggaagtttaggccattagaagaaaccattgatgattctgttgtgagctttgaagcagctggtgatcttccaaaggcataagcttacagagtcgtcacagtgactgtttcttcacttttatcactcctgaaataaagtggtttttgttagaatcatttcattctcaaatccattatctattactatcatattagtgttgttctttgtaacagtcagttatttgtcactttcaccaacatgaataatttgatggaacatgtcagattctcacggtttctttttcacaaaacaaaactggttttgaatccgaccactagactaaagtgtccatagtccgcggcaaaatgaaaaccaatttaaatgtcgttatacaagctttgtagtctagtagagatatacaaatttaattgtcgttgttagttttgtagtctagtagatatgattagtcattagttacggtttcttaataacattgacatttagaccacaatgtggacttgtggggttaaatgagtcacgagctcatgaacccctagccatttatttgggattttccgaggacgaggcttaatctacaccgtccgaattcgttaatgacggcaaattgcttccatgagtagatttttctttgtctcattagtcattatacaatttcaattctaaggataaaataatcaacaaagtttgatttcagttttttacattatttgtgtaacgttactacaacggatagatttgattcagacaaaacaaaaagatcgatgattacgacgttaattacagaattagaggtataaatatatgggtcccacgtcatttacaatggccagaaacaaaagtatctctttctctctctcttcatcttcaacaaatcacgcaccatcataatcatcatcatcttcatcgtcatcaccaacttcttcatcatcaccatcaatggaattccccaaaccaaaccacccttcaccctaaaaatcgtttcatcttttttccttcttctaattttttttaggtttttaattaacttttgcttcaagttttcttctatagatttcttactcagaaaagtttcgaattcgaccctgtagcttagttgttgtttataatttcttgtgatcattcacagtacaaaaaaactaattcacccaccgacttcttcttcttcttctcttctctgtggcccatccttaaacccacactgcttttgcttttcctttttttttccgggaaatttgatctctttacctttcgtcattattagtagggaatgatcttttagttttttttttgtttcccccaaatctcactttttctcacttcctctccatctcaaatttcacacaaccgagtaaaccctagaatctccgcttctcattcaattggtttcatcactggtcttaatcattgctagggtttactcggttacctttatcatcatcaattgatccttgttcataattcatcctcttttctttctgtctttggcataaagtttcaatttttcttcttcttctctttctcactcaatc

SEQ ID NO: 530 - DNA, 3000 bp, Arabidopsis thaliana
atcaagtatgtgaggtcatcgagtgaaagactcaaatctttaaatctagggttgaggcatgaaatgtaagtaaataaaacttatgtctagatgttgttactaggtggaattcgacttatcttatgctcacagttgcaatcacgtttagaggtgcatttgataagatgttggctgaagataagttatagaaaagaatgaagatgatgatgctgatgatgataatgatggcaaacatgttggtcctccatcttctgctagttagctgggatgaagtgcaaatgttagttaagtttctgaaaatcttttttaattgcattctttcctcttcaacatttaaataagtgacatcctctatttggtataatctaatgatgatggttatgagatgatggactctttgtacactaagatggtagcagagactacaaatatagaatctagtaaggaacttgacatttacctgcttgaaaaatatgtgctaagaattacaagtggtttgagattggattatgatgtcttaagatggtggaggaggaatagttctaaattgcaatctttgcagaattaacaagagatgtgcttgtcatacatgtctcctttctcaatttagagtctgcattcaacactagtggtcgtattttggatcctttctgaagttgcttgtcaccactcatggttgaatcattgatttgcattcagcaatggctcatgaatatcattagttgagaagttagcaaacctgattcagatgttcgaagaattaaagttttatgagtctttaagtactcattttctctctatctttcagtttttttttgttgttatttttatatctatagactcaactacattttatttgccttgtgtagcttctgagagtactcatacacaatcattagttgctcattgacgtggagttgaaaattgaggtatatttgatatatttttttgtcattcatttacctgtgagagccttttcttttaatcagtaatatatttttattttctttcacaacagacaaggtgacaaatgcattaagatttttaagcggcttaaaggcttgtcttttctctttatttattttgtataactaactctttctcttttggcatcgacaaaacaatgacaacataccaaatggacctgtaagaacttaggcagaatggatcattggtagtttgtcatttgtgtcaagttacatgttttttggaacaacttatgtatcttttgtatatatcacgatgattaaggttcgctactaagttgttgttgtattaataattgatgcgtctttttgtttggttgattttacattcgtttagtgatcagaccaaaaaaactgaataaaccatgtttgaactgaaccaaagcgaattattaatcggttcgttttagaaaaagttcattttccaaaaaaaacaaaaatcaagtaacggaaacagaattaactttttcggatcaaaattgcatgcctataaaattttatgttattaatccaaatccatccaatcattttttttcgtttttgaaaccgataaattatttgttattgtttgtgaacaatattcaaaagtcccaaatcaataaaaagaagaaaaaaactaattatgatttggaaataaaaaaagaattaatcaaatcaaattaaaatcctcactaaattgtaaacatggtgtacataatatgattacgtgacaaaatattattgaaaagatatccaaaaaattgcaaaaaaaaaagaataagaaaaaaggccaaaaccaaattctcaattctggtcggagtttgtctttataaaaaaatcttagaagccatatatattttctgtttatatattttgtacaacaaactctttctcttttagcgtctacaaaatagtgacaacataccaaatacacttataagaactgaggcaaaatggattattggtactttgtcatttgtcaagtgacatgttcttttagaacaacttatgtattttttgtatcatgaatcatgatgattaaggtttgctaccgagttgtttttgtattcataatttatgcgtcattgttgttaacttgttgtttggttgattagtgatcagaccaaaaaaattgaataaaccatgttcgaactgaacaaagcgaattattagtcaattcgttttaggaaatgctttattttccaaaaaccccgaaaaatcaagtaaccaaaaccaaattaaccgttcgaatcaaaatcaaagacctataaaattctatgatattagtccaaaactaaatccaaatccatccaatcatcttgttctttttccgaaaccaaaataatatttgttattatttatgaacaatattcaaaaatcccaaaccaataataataataataaaaaaaaactaattaggatttggaaattagaagaacaactaatcaaatcaaataaaaatcctcactaaattgtaaacaggatatgattacgtgacaaaatattattgaaaaaatatccaaaaagttgcaaaaaaaacaaaaaaaaagcataagcaaaaaaaaagagaggccaaaaccaaattcccaattctggtcggagtttgtctgtaaaaaaaaccctagaagccatatataaacaccacaagtaaactcgtttcttcaccttccttctctccttcactctaattgcgattgattctcctgtcttctccaatttatcaggtaattgcttctgcttcatacttcataccttattttccaatctctcaatccatctttgtattggagcaaagtttatacctttcaatttctcaaactcgactagttatagatctatggaagttcagttcaaaccttacatatataatatctggagaaaccaactatgtgtacttgcaattacaataagctaatagatttcgtactataaagttagatccacatagtacaattctaagttatgcagattggagctcttgtgaatttttgtttgattcgattttgcttgagactgtcttagagaaattgcagag

SEQ ID NO: 531 - DNA, 3000 bp, Arabidopsis thaliana
actccatgggactgcctcacggtgtctccgatgcgttcacaagaatcaagaccaatcttgcttacttccgtatgaactacgcaatcgttgtcttgatcgttatcttcttcagcttgatctggcatccgacatcgctcatcgtcttcaccgtcttggtcgttgtttggatctttctgtattttctccgtgatgagcctatcaagctgttccggtttcagatcgatgatcggacggtcttgattgttttatcggtgttaaccgtcgttttactcctgttgaccaacgcgacgtttaatattgttggagcgcttgtgaccggagctgtgttggttttgatccattcggtggttaggaagacggaggatcttttcttggatgaagaagcggcgacgactgagacttctgggctgacgtcatacccgtcgacttaaatcgtttcatctcgaaatttgtgtatcttttctatttttgtatattatcttgtttttttaattatgcgtaatcaatttttattggtgtgagtttggtttgagactttctctctctcttttgttttctgagttttgagctctgtctgaagtttgaacaattctaatttgttataatttttattactccctctgtccataaaagataaattttttaggaaaaatatttgtcttacaaagatagaaattttatatttgcaatgcaaattttaaaattgttttcccgttttacccttactaaataattagataaatatttattattatttttaaaatatattaagaggttaaaattatgtttatacaatatttcttaaaaaatgtgcaatttctaaaaaattcatcttagtgggacggagggagtattttatattcgcaaaactcaggaataatttcttggaatgatttattaatctgaaatatttaaaatgatttaatctgaaatacataataaataatcaaattaataagtcaaacattataaattcaaaatgggttgtaatgaatattccctttttgcattccgtaacaaaaaaataatcaatttttgttgtaaagtttattcaggttggttcaccttcaaagtaggaaaaaaagtttggtcttgatttaagttcttttttcatttgggtcacacaaatgagcaatttgaagcaaaaatccttgatatatatgcaggccttattcaaatttccaatgtaaagatttgaagcaaaaatccttatatataattaggtctttcaaaaggcacaaatattctagcccatgtaattctaaacggacgccattagatatgtaagagcatcttcatcagtagtctttcaatgagatacccaataaaaaaaatataataaaaaaggaaaaagtaagagagaaggaagaaaaagtaggagagaaggagaattaagtttcttggaggagaaactttgagaaactattctcattcaatttggacagctgttatcctattattagtttaactattaaataacaattaatatatctgtcttaattaaaatattaatattttaattttttgaaaaactttccttactgatggagatggtctaacagtattgagcatacacatctttgtacgcgtcagctcccttcgccggcgcttaataccaccgccacacttgccgccaattagaagcaaaccggtttaaagtggcgtatcaccaacattacgatcttaactacgtctatcgacatcatcctcatccccataatcttatccactcaagactcaagtacactggacgtggcagaccaagtttttctatttaattcttccaacttcatattccaggaactcgatcgactttcagacattgaccaaattgaatcagatcataacgctacatccttttatatatatataacatcacgctacattattgtaataatatcacaaaatttctacggaaaaaaactcggtctaatgttttaacacaccatctaatttatttggttttattccatatgcaaattcaagagaccttcttcatatattatacacagagagataaaacaataaatcagaacagttttacattatttcaatcaagtcatcttattcactaatggcgaacaacgacgagattaccacgtcgtctcatgcatctccggcagtgaatcacgagtctatctcacgcgctaagcaacgtatcaaagacggactagccacgcgccgctcctggagggtgatgttcgatttacactccacgggactacctcacggcgtctccgatgttttctcaagaatcaagacaaatcttgcttacttccgtagtaattacgcaatcgtaatcttgaacgtcatattcttcagcttgatttggcatccgacctcgctcatcgtctttaccggtttggttttcctatggatcttcctttattttctccgtgatgtgcctctcaaggtgttcaggtttcaaatcgacgatcgtgcggtcttgattggtctatcggtgattaccatcgttctacttctattgaccaacgcgacgtttaatattgttgcggcgttgatggccggagctgtgttggttctgatccatgcggtgattaggaagacggatgatctttttttggatgaagaagcggcgacgactgagacttcaggactgacgtcacacccttcgtcttaaaacgattgatctccatttttatgtatattctattgtttttgatcatcttatgtgtaattatagtttatggtgtaaccgtgtaagtttggtttgattctctctctgtttttaagttttgaagtatgaacaaacttaataatgtcaaagtcttcgcttcttgtttttggcgggctgcttacttttatcactttttggcgccttattgggccattcattaaggcccaatagtatcagcccataaaattcaaaaaggaacatatttttacatttaaacagtgtgtctcacacttccatttacacgtcagctctcttcgccggcgcttaatacaaccgtcaacctcgccgccggctagaggaaa

SEQ ID NO: 532 - DNA, 3000 bp, Arabidopsis thaliana
cgaaatttattgtaatgtttaggtaggagaaaacccagttattgaatcgttgaattgagtccatttacgttttctgattacagcttgaagatgggagatgaaactgttgacggtatcgaagccaagtatatatctggtctcagtactataatggttgctacaattcaagaagccaaggatagaatttctcagatcgagtatattttttgtagccagttatttccaaattttcaatccaaatccaaagcttttgaaaaagtttattcagaagctcgtcttgctgcttgtgatacttggaaagatagagagaaaagtttgttagatcagattgaagagcttaaggtagagaatcaacagattaagtcagataaggagaagttagctgaagaacttggtaaaactgcttctatgcctcttagattgacgagtctacaaggctacatcgatcatttgaaaaagaagatgaagagtagatctaagatggttggtgatgcaagagatttgtattataggttagttgagttgttgcaggttaagggtttggatgagcttagcgaagatgggataaatatgattgtttcggaagtgaagagccttaagatgaagactgaatttcttcaggaggaactctcaaagaagacattggtgacggagaatctgctgaagaaactggagtacttgtctacagaagctgcagatggtgaaaggaagttgagcagcgttgaagaagagaaacaaagattgaagactaggttgcaggtttttgaggagaatgtcggtagacttgaagagatacttaggcaaaagaccgatgaggttgaggaaggaaagacagctcttgaggttttgcagggtaaactcaaattgaccgagagggaaatgttgaattgtaaacaaaagattgcagatcatgagaaagaaaagacagtggttatgggaaaagcaaaggatgatatgcagggcagacacggaagctacttggctgacttagaagctttacgttgccagagtgaagagaaatcatttgagttagctatggagataaagaaaaataaagaactctctcgtacttgcaaaaagtggaagtcccaacatacttttctctgcaaaaggtttaattttactcctgacagtgttcttcaccaaagcagccttgaggatgagaataaagaaattggtcagcatgagaaatcagcaatctcgagttgtaagtattagccgtctctgacctagactactttgaactacctctcgcgttaaattacttgctatagtcagtcatcctttagctgcaggtttcttattggtattagtaaactcacccagcttgattttttactctctctattacagatcttgaaaggaaacactcagaaactgctgaaggagcagacaaagtgagaattggtactggctcgagtggcaacaactatgagaaagagagtataatcaaaacagtgcagacacctatcacttccatctcaccaattgtgcggtcacctggtgctgcaaaacctccacagctaagcggattaaagcgtccagcttccatttggagagacacaagatctcgtcaatctcctggaggacatgatcctcatgatgattttctagatactcccattgagaatgtcaaaagggtcgctggggaagaaaaacatgttcatgatgttgctaagaaagatgattcagacgacgagacacaggacatgaatcctaaaccgagtccatcacgacagcgaattcaaattgcagaaacgagtaaaaagagtttcaagcatgtggagtcagtgaggaaaaaagccgagagggagaatttgaaaggtatagaatgtaaacaatgcaagaaattctatgatgctgttcatcctgagaatgaaggaaatggtaacaaaagcttgagatgtgaacatcatgaaggtgtgtcgaggcatcgttacagatacgctcctccaatgactcctgaagggttttggaacatcgggtttgaatccgaaatgtaattctgtatcttgacattctttgcatctacgttctttggatcgaaagactatacaataaagtttttctctgctttctcgaagaaaatgtcaactaaaactcttgtgataagttatttatcaatgatttaaagtcaattccctatgcttttgtgatcttcaagatacaatacaaacacattcatgctactaagatactaacttcaaatcttggcagatatcagctataactatatcaatatgaactgtttacgcatgaatcaatcatacaaacacaaaaagcataggaaattaatcatgcggtctagaaaaatgtgtaaatacaaacaaatatgggggggggatttattttagaaacattcgggctctttatgtaaatacaagaaaattatgtgtccaactgaaaacaacaaacaaatatgggcctcctttacgtgttatatattagatgcacaacaatcgacttttctgattacgattcaatcctctccgatcgttggcctcctgtttccgttttactcgacatcgttccgacgacttttgacctggaatcgacgcaggtaacaagatcgtaatctgttttttttgtctaattcggtttttcttcttctatggatcttaatttgataatttttgctttgtttccgagccgattgaattgttgtaacctaggtcttcctgccttttgcaatttcccttcttcgctcttagttgattctaggtttctgttggttaatttctgaagcttggttctgagatttctagatttgtttttccatcttaggcgtttgataggatataattgtgcttttcgtcgttctatggaatcgaggacgatgatgctccttttgtatttgattttattgaaaactaccagaagaatccgtatgctattgtattttcttttgagcttaaatagttatgttggttgctaaatagtttgagagcttatctgttcaacagtgacttcaattcaactattgcacttggtttgttggca

SEQ ID NO: 533 - DNA, 3000 bp, Arabidopsis thaliana
gtgttgtgaacaacgaatttcttgaatccattgggaagatagtgacgagtcttcttgtcagatccgtaaccaacattgggcatcaaagtcacacctttgaactttcttctcacccttgaatcaataccctttggcctcctccagctttcctgaatatttcccaaccacaaagtacataagaaatcaaaccaaatcaccacaaacatgtcaaaaagctcaattcttccaaaaacgacataagagactaatctggaatcaaactcaacctaatctggaatcgaatgaatattgttcatgagagaactcaggcaagctaaaatcatcattttcatgtaatatcttcatagatagagactaatgtcagatgtttaattcaaccaccatattgcatcctaaagctacaaactttaagatacagctaccaataaaaacttaaaggaacaaaacccagagattgatctactaaaatcctaaaactctgtgaaatcaaatgagaaaaagggtttaccttgacggtgattctacggtcactctggggtctgatgaacttagcagacctcttcttcacaaccttcttggtaagcaatgggaccgccatatttgcttcttcgtaagatcgatatctcaaaagcgactccgtaaaacagctgaacaaacctaaaatgtcttttataagcgtacactagggtttctgatattacattactaaatgggctcacgttgtggcccaataagatttctttcacggccttttcgttttttccttcaactaaagaaattgtatgctcttaagaaaacaatctaatttattaaactaaaaggaaaatacacttttttcttcaattaagaaaatttttcgttttttttttttcactggaagattaattttcattgatgagatattaggtgaaatacaaaaagccgacgatcaatacatgatcccggaaactaagtcgaaggatgacaaagatatcctcggaaactaagccaagaaatatggagagcaaataacaacactacaagagaaacaagtcaaaacaatgacgactaaggaagcacacaacaaaggaaatcaaaactcttaactcagaatctagcaccaaacatcttgcatattatcaatccagaaacgagaaacgcttgaattgtttctttcttcctttttctttttttgtttcttaatttctttttacaaaatatcattcatggtggtcttcttctgctcgacgattgtggatgtcgtcacgacaagtaggacatgatcgcttgcagcgtagccaggggagaatacaatctttatgaaaactgtgagaacaaagcaacttcatgatcctcctctcactacctgatgatgctaactcttctagacatattatgcactcttcttctattggtattagacaaccttgagagtcataatcattgactcttaaccaatcactatacaacgtttctagaacaacttcaacttcaaccaagaaaccatctttttcttcttcttcaaggtggcgtcttatatcaatcaggtcttcgcagattttaggaacaatactttgctgaatccacttgttgatctttgacttggacaacacgttagccacaaatatactgcatatttcttctccggtgaggaaaacaggtgggatctcggatgcgattcttactgttgcattcttctttcctagcgatttttgttgagccaaagtttcacgaccgctaggactccggataagaatccgctcaattccttggatacttattgagaaggatcctgaatttttgtgatcgacgatgtgagtcttagattcatagtttagaatccatgttgatgtgccctccataattaaaagccttgttgattaaattatgtctgttttggctctaaaacaatcgatctcttctttatttatagaggttcattggagtctccaaattcacttaggtttcaaatttacatttatttagaaaaatagaaaaaatgatgccctaaataaatggaacatgtttaatcaatgattatctaaacacaaaattaaaaaattcgggccaaactgattttttttgttttgtcaaatgttttagttgactaagtattatcaactaaaaacaattaaacagatatatttttcggattccaaaagaagtttaaatatagttgaatttaatgggaaaaaatagaaaaaggagtaaaaaatgtcgagccacttggtcctttgttactcaatcattcgccgttgttccgatcattactcttctcttctccatccaattaaagattctctcttttaataatgctttcaaaagaatatctaatttcaggaataatcaaaaacttatttaatttctctcttctttatcaatgtgtatatataatacacacatatataagaaagtgtttcttctgtattcgtgggagaaacaaacaaaaaacaatttcttctaggtaagttttttttttttgttcttcctgctaaagtttcgatttttaaactaattgatacttgtgtgttcctttggctctagcggcaatgagtttgtgttagtgatcctgctaaatacaacaaaagggtgaagtagaataaagttggtttcttttttaatcaaaaacagttggatgatcacagtttagcttcttcgatattgaaaatagggttcttgttctgtttcctttagttccctctttcctctgctgtgatcgtttctgtcttgatgatgatgatttaccccaataaggttttgattagggtttataaactcagtggaatcaaagttcagggtttatagagattgaatcattaaggatttgtttgattattattgctaatggaatttgcaatcctctgttttttaaaattgtatccatcttggtttagaaaatcatatttctctgtttcaattggagtcatctttcaatcacttgcctccatcagggtttaaaagagtccccttttcgtcgttgtagcgaagaagcagaattaatcaaagttcagagctttcact

SEQ ID NO: 534 - DNA, 3000 bp, Arabidopsis thaliana
tatatcctggaatgctatgatatctggatttgcacaaaatggattctctcatgaagctctcaagatgttcttatccgcagcagcagaaacaatgccgaatgaatacactttcggaagtgtcttgaatgcaatagcttttgcagaggatatatctgtaaagcaaggtcagcgttgccatgctcatttactgaaattgggtttgaatagttgtcctgttgtttcaagcgcgcttcttgatatgtacgccaagcgtgggaacattgatgaatctgagaaagtctttaacgagatgtctcaaaagaaccaatttgtttggacatcgataatatcagcctattcaagccacggtgattttgaaaccgtgatgaacttgttccacaagatgattaaagaaaacgtagcaccagacctagtcacttttctctctgtgttaacagcttgtaatagaaaaggaatggtagacaagggctatgagattttcaacatgatgatcgaagtctacaatcttgagccgtctcatgagcattactcatgtatggttgatatgcttggccgagctgggagattgaaagaagcagaagagcttatgagtgaggttcctggaggaccaggagagtcgatgcttcagagcatgctcgggtcttgtaggctgcacgggaatgtgaaaatgggagcaaaagtggctgagcttgcaatggaaatgaaaccggaactgtcaggttcttacgttcagatgtataacatctatgcagagaaagaagagtgggataaagctgcagagatcaggaaagcaatgaggaagaaaaacgtaagtaaagaagctggattcagttggatcgatgttggtgacactgaagggtctttaacgatgcaaggtttctcttcaggggataagtctcatccaaaatctgatgagatttatagaatggtggaaattattggattggagatgaatttggaggggaaagttgcagtttaggactcttactcaaagttctaaagagttgtagttatagatcaaaaattagaaatgttagctatagatttacatgaactcactgagtgtatgattacttttatttttgcacctacatacgtgcacattgattttgtaaggaccatggtaaaccggtaaagcatggttctctgattttgaccttattgaccggttcgattgattaatccaacgctacgatcaaaatagacgactctaacttttctaggtcaaccgtaaaatatatatactttaatttctacaaatagtatcttgaaactattaaactatttattaggttcgaatttggttggtattattcccaatccaaaggctaaaatcaaaaaaaaaaaaaaaagtcaaaataacaatggattttaactacaaaaagtttcaagtttatgggccatttcaagtttgaaacttttgttgttttttctatctaacgaactcaaaaagagaatatgatggctttaaggtatgagtttggtgttgtactcttactcacgtctctttacatttatcattgtataacaaaataagattttaatagtaactttgaaatgattcttaagcaacttaaaaagcgagagaagagaatgtttacgtcgtcgataacctcataatgcggattattcttcctaacacgttaccctctacgtaccccacttgataagccagtttacactttcccttccaatttactttttctaataaaatacttttgtcttccgtcgtcaaacaaacaaatgtatgacttaataagttctatcaaaatgaacgttcatatactcagctgattataattgacgcaacttaaaaaaaacagaatgaagactcatatattgtaacatggcttgtatcaactataaataatatttgtctagaataaagactccgatggtggttgaaacttcaaactaaaccacccaggacacagcttaacgtatcattataaattaaagataggatagtaccatactagttagtaatttgactatttattaactacacaaatttttaacagatttagaacttgagtgttatacatattgaaagtacctgtaacttgattttatcaaatcagattttaagtacttattaaaggctgaagcatatgaaaatataaatcaatttatatatgacttgttgaagcttttaaattaaggagcgtatcaaaaaacttaaaacacacaattaacgcgcgtgtccacgctctaagcaaagcgagtgaaacatattaatttacacaatcgaaccgtcattaatgttatgggttgtctcctatttctggtttaaaagagatattaacttaaatcccacgtcaccaaatattaaaaataaaataaaaataaacaaattatataaatttcttaacgcacaatttgttgttttccataattccatttacccgaaaccctaatccccaatttctctttcaagttttcgatcacgatctctggaaaattaagagagaaattcaaaaacttcgggagttcaaagtctcattcagacattccagaaggtgatctcttgtttcagtttttctccctttttgttgattgtttcaatattggtgttttatccttcgatctctatgaaagttgtttcaattggatcgagattcttcgctgtttattgattttacgatacccttttcaatcgtttggaagtttttttggtttgtcctaattcgaattattcttgctgtctgaagaatctgtttggaagtaaatttggattaatcttgcttagcttgtatctcctgtgattgatcgcgattacgttggttcttctttctgtttacgcataattttactgattcatctaaattttgttgcggctttcttatgatctgtgttccagagtttgtggattattacatcaaactatatgtttttagagttgtttgttttattaagaatgtatgatcttctgctttggatgtttgctcacatatggatatttctcttttgcaggtattctagtcgactgagtaaacaatc

SEQ ID NO: 535 - DNA, 3000 bp, Arabidopsis thaliana
tgttagctgtgtgtcatggtgaataactgcttctagttttttttggtagggattaacttcttctagctcgtggtaattgttttatatatcaaatatatattttactaatatatatatatatatatatataaataatactaaatatgatgaattaattctatggtaaaaatgtcagtagaagtagctacactataaactttggtatgttatgtatatttttatataacgaaagctacattttgggtattgtttttatcagggaatgattgatattgaagcaacttttatttagaaattcattaaaacattttaatggttctcttgtaagattcacacctatctttaaattttctagtcaaaaaaagaaagaaaaaaaaagcgagagagcttctgtttttcaaaattagtgcaaaacagaacaaatgcgaaattgtacattttttcttattaaaaattattatagccaaaaaaagaaaaatattatggcctcctatatttgtccccaatcatcctatttattttgacactgacttttctcacccctattattaggcaagttctacaaaaatgatggccatgaaaaatcattatgagttattttccctcgtggctcgcgatggttatgtttttttgacaccgagtctcacgtgacttccacgtgaactatatgagtggaggttttggatatggatcaacttgaccatatactagatttgagaccaagacaaaagagagttcttaaaagtctcccaagatcaaaacagtaaaccctaatgattttctataacccttttgttgtatggaattttagagaatacagaattttagtgtctctttctatagttttaggcttttagcaaaaagtctcaccttttctttgtaatttctctaagataaattgtttttcgaaaaatgctcaaaaagtactgcaaatcagaatgtgtactgcatatcttctatctacgcgaacaattggaataaagcactgttattctctcgtgaaacgttgatacattatatacaacacatatgagtttgaagtttctgtattacagttttctttttgaacagaaatcatttaatgaaccgtgttacttttttttgggtaacatgaaccgtgttactataagactatgaattataggaatcttctaatttgtcatttatgtacgagttaaattgtatttgaagtttcatcaaaaattagtacttgattatgtcgaatattatctatatttctagtgataatttagtgttgttacatcaaatattctaatttagaaaagaaaacaacatgtgtgtacgatataaattgatagttttattttatttaaagtaatgagatgcccttaaaacaaaccttttactcattataataatattatcaagaacaatcttgatcaaacaatgtatttatcatttacagccaaaagtaaaagaatttgtacttgatatagactccatacaaactgtagtaagagagatgatagaatataaatgttccccatttatttggtggaggaccaaatgtggaccaaaacataacttagccaatcgcatcttaaggcaatcgagaagaaactacatgcatgggcatgcaactatactgtttcatttattttgaaattcatttggtccaaatttatcttcaattcctttaaaactagatgtacatgacaaggttgaagtagggaattcacgtaatcatacttttgactttgacaactatatttagtcattcagtgttttattgctatatcgaattatgttcaatgtggcaagaccacgagattatgtttcatttagttaacaatttatgaagttttgaaaacctttgtgtaaaaatactgtaacattacttaaaaacctttctgtaccagtacaatcatttcgacctatattctaaaatgtaaaagtaattcttacattattcttctattaaatgggaaatcaataacttatacggaataaatcactcttaaacttaaatggtcaatttcaacatgtatagtgatcaatttggtaaataatatttgatgatatgttagtgtatagatcaacattccttttaagtggttgataagagagactataaaattttaatctccgagtcatcattccaatataagtgttctcaagatttgttgctctctcatgtcctaatcgcttagggttccaatccaaaccaatgagtttagtcacatcacttacaaatgtgtatatcaatatatctttacggaaaaaagatatattgataaaggatgtacaatcaaatacaacaaattagtatgcaatgaaaatacaattttagaccagaaccacaaaattacaactactcaatatatcgagtattacaatatattgagctataattcaacttttcacctatagttagctagttttgaccataatttgtagtatagtagtatgtgttagtacgtcgatgtgtcaacattcatgttcaaacttgcatattacatgttattgacatgttcttcctgtagtatacaaattacacattttcataacttcatatatgaatctcctgcaattttacctgcaaactattggtcaaagccttttaaatgggctagatcaagcccactaactgccaaaatattcacttcatttattcttgtagacagtatacacattatcaaatgtacacacattttcatgatttgatcttagatattatttcatgcaattttagcctctattgctaggctttcctttaaaaacttaccgggctaatcaaaacctcttaaaaagcctccatatcaaaagcccatcaatgttacctcgaacttagtggaatcaaatacggtgtcgtttgatagaaaatgacgaaactagccctttgaccgttcaggaaaaagtcttccgacatataaaaacggagaagcgagaagacgtgtcggctgagaggtaagaggaagagagactcaaaacggcaattagcgaaagtgggcgggaggattcttttccggcgactctttt

SEQ ID NO: 536 - DNA, 3000 bp, Arabidopsis thaliana
atagtttctcgtttagtttagatatataaatacaaagacttgagacgacttctaatactccggcaacgatgattaataccgacgataacttattgatgatcgaagctctcttgacctccgatccgtcgccaccattacttccggcgaatctcagcctcgagactactctcccgaagcgtttacatgctgtgttgaatggaacccacgagccctggagttacgccattttctggaaaccgtcgtacgatgacttttccggtgaagcagttctcaaatggggcgacggagtttacactggtggcaacgaggaaaagacacgagggaggttgaggaggaagaagacgattctgtcgtctccggaggagaaagagcgtcggagtaatgttattcgggagcttaacttgatgatctccggcgaagcgtttccggtggttgaagacgacgtcagtgatgacgatgacgtggaagtgacggatatggagtggttcttcttggtttccatgacgtggagttttggtaacggatccgggttagcgggtaaggcgtttgctagctataacccggttttggttaccggttcggatctgatttacgggtcgggttgtgatcgggctaaacaaggaggggatgtagggttacagaccatcttgtgtattccttcacataacggagtgttggagcttgcatccacggaggagatccgaccaaattcggatctttttaataggatccggtttctttttggaggatccaaatatttttctggagccccgaattcgaactcggagcttttcccatttcagttagagagcagttgttcaagtactgtaaccggtaacccgaatcctagtccggtttatctacagaaccggtataatttgaacttctcgacgtcatcttccacattggcgagagctccatgcggcgatgtactgagttttggcgagaatgttaaacagagttttgaaaatcggaaccctaatacttattctgatcagattcaaaacgtcgtccctcacgcgacggtgatgctggagaagaagaagggaaaaaagcgcgggagaaaaccggcgcatggtagagacaagcctttgaaccacgtggaagcagagaggatgagacgtgagaagctaaaccacagattctacgcattacgagcggttgtaccaaacgtatcgaaaatggacaaaacgtcgttgctcgaagacgcggtttgttacataaacgagctgaaatcaaaagctgaaaacgttgaattggagaaacatgcgattgagattcagttcaatgaactcaaggagattgcaggacaacgaaacgcaattcctagcgtttgtaaatacgaggaaaaggcatcagagatgatgaagatcgaagtgaagattatggaaagtgatgatgcaatggttagagttgaatcaaggaaggatcatcatccaggagcgagattgatgaatgctttgatggatttggagttagaagtgaatcatgcgagcatttctgtgatgaacgatcttatgatacaacaagcgaacgtgaagatggggttgagaatctacaagcaggaagagcttagggatttgttgatgtcgaaaattagctgagagtttctgcggtgtgttttgagaaaattaatcatggggtcaaagtgtaattaagttttgttgattttctcataagttaatggccgttttattagattttggataatatacagttctaatcttgtgacccaaaattagggggacttattgcaaatggtcaaccctggaatgaacgagatgaacacaaacacaaatggtgcttgaattctttttttttttgtttcctcttgtttgttcatcttactaacatgaaaaagatgaatatttatattttgcactttcagcccaaatggtaaaaatttgggttgaatatatttttgagaaaaatccaaaaaaagattattgcacgtttaatatccaaacttttttggttggaaggaaaatatacatagtttaattaaaacatataatttaatttctacaattttactcaagatctaataacaaaagcaaaattctagttttactcttaccatctcaattaatttataattgacatggtatatttgatttgaataaaaattattttttgttgataggttgtttttattaaaattattttattttgactaccaaaataaaaattagaagaaaatctttttaaaaaaatcttcaactttccttttttaaaacacaccctttaatagataaaattagggtttttggaatgaaatgttgaagaagatcaaaaaatttagattttttctatcccaatttaagtgggtgagtaagacaatacatttcttgctatccttttgtttttaattttcaaagaagaaatttaaagcatacatgtatcttaggtttaaaactgatcttgttattatatatagtttcaaaatccaaaacacacatcacaagcgagatattcttcattaaaagaaagaacaaataaaatggagagtagaagatcttcctatgcttttgtttcggttttgatccttgtggtgctcttgttttcagggtcaaacttgttgttgcattagaggactatcatcatccacaaacacttaattgaacaactccgtaaggttccaatttgtatcattaatgtgtgatgtgtccaactcctaaactaaagtctcaataaaataatggagttatcttgcttactcgtacatgtatggaataatggtgtagtagtgactgatgagatttacaatgaatcaattctgaaaccaaaaagtgattcagcccaatgatgtgtgttttaaagcccaatgactaatgggcttatttaacccaaccaaataactaatgggctgaattcggatcatttaaacccgacccggtatcatctctatggcgctctctggttaaaacatacaaacttttagggtttcttcaatctctctctccctctttcttcctcttctctcattgaaatcgaacgagg

SEQ ID NO: 537 - DNA, 3000 bp, Arabidopsis thaliana
tatccttcattgccttctgattcattattctgtgttcaatttcttgtcttcactgtttagtacaatgctcgttaatgataggactatgatctcatatgctcgaagcataaatgatttgtgtttgccacatagactgggcttctctttgtcttttccattgttttctgtggatatttttccttgacgtggcctatagtattcaacagctgtgatgtgttgagaccttatgttactcacattgatgatatctttaaagacttcacttcttacaagtgtcgagttccagtcactggggcaattatcctggatgagacatatgaaagggtaagaaccctgtggggtgatatttaggtttacttattagttaatgcttaccctttttgtttcattgtcattttcagtgcctgttggtgaagggatggaaaggatcgagctggagctttccccgcggaaaaaagagcaaggatgaagaagaccatgcttgtgccatacgtgaggttagtatcaattctgttgtttcctgtctcttttgtgtttcatttattttacacttttgtagcaaaattgatatctccaacaaccgccactcattgatcatagtgcatattaataaagaacactatgtaattagaagaagaccgcttattgggttagattaacctcacttagtggatgcattggttctactttagtggttgttgacatatgaaaatgtgtcaacataatgtgcgcatgaattttttttagtatagatgacggaggtcaaagaatagcaaatagaacgtctcttatatcttctgctcttgaaacagagtaactcattttcacactaatttaacagtttgatcataacacatacaccttacgtactgaaaatagattctcctacgtgataattgaggaagaaaaaatgttcttaggtcaccagtagacagaatcttttgcaaatgagaatagtgctgctgtcaatggtcaactatataggctctctgtatctttttactatttcattggtatggaaatggtcaaaggtttaattgtagctctctagtgctattctcctggtgaatgtagcatttcaggtgctgtaattcttcttctgattgtttgtatagacttggaatatgggttaatgttgaaaaaaaactgaatattttgtcacacttcttatgtattgttcttccatgctaaattacaggtcttagaggaaactggatttgatgtctcaaagctactcaagagagaagaatatatagagtttgttttcaggcagcaaagagtacgactttacattgttgctggggtgacagaagatacagtttttgcaccacttacaaagaaggaaatcagtgtgcgtatttaacaattaacttgtggatctgatcttgtctgtgtatgtatgatgagtctcttatcttcttttgttgtggaatacttgtaggaaatcacatggcatcggcttgatcatcttcagccagcaagtaatgaggtgataactcatggagtttctggtctcaaattgtacatggtggcacctttcctttcgtgagtagtggctctctaatttatacacatagatttttgggtgattttcgtgttttggttcataacaagagagattacaaacttgtgcaggtcattgaagtcgtggatattaaagcatccttcacctgtagcacggagacctaacaagccccttaaaggtttgacgtctttttctcaagcattcattaaaagagaggtttttggtagagatctgactatatatgctttgtacagcactctgcgtgtggaatgcaaggactagtgttggagggaacgggacagcaacagtggaaagccaaaatagaaagtctgaactcaggacaacaacaatggaaagcaacagtagaaagcctgaactcaagagaacaacaatggaaagccacagtacaaagcctgaactcaggaaaggaacaatggaaagccacaatacaacagcaacagtagaaagccacaatacaaagcctgtagtcgaccattctcaggacataaaacctggtggcagtttcataaacttcaagttcaaccagtcagttatcttacaggcgttggaatctggtaattcagcttgactggtcagtttgtcacatatcggttggattggtgttgggagtaatgatgcggttggattggtgggtttgtctatagcaaaaccgttggatatgttcatacacgctggtagctttctatttctttgccatttggtttatatacctctcgtttcttctagaatgaaagggttgttgtaaatgatgttagtagggaagtggtgaatcctttggatcatggctttagatgacaatgttacgaccagctataaaggttaaaagagtttcttatccgagtagtgaatcgatgatcttctttatagcgccctctaactgcttaatcgaagcagaaagtgtttttctttttagaataaaaaatgaactcacctataaaacaaaaagtcgcacctaaataagtgaagtttatgtaatactatgattaccttggaaacaagagatatctcgagattgtttagtttttttcacattgtaatttgttagtataaaaggtgggtgggggaatggtggcctaaattcggcaagggtggcctaaaaaatacatttgattgctatacgaaaacattttaaagaaacagaaactgacaagtggcattttgtgttttacacttttacttgcttgtgtttaggtttggaggttcatctacataagcatcagcattgtgactttgactctccccatcaaaattaatcctaaaaatcaaagcatgttaaacagcccaaccacattgagaattttatctataaatagaattagaaattaaatccttggttaaacccataactcttctttcctcttttcttctccggctaacggtagttttgacgccgttagtttttcctccgtctattgatttttcccgcttcacaatcgcaacaaacccaaagaaga

SEQ ID NO: 538 - DNA, 3000 bp, Arabidopsis thaliana
tctagttacgagcaagaaagaaagaggcatggtaatcaacctttccaatatgcttaggtatgcgttgcttgcacactccgtcattttctctaacaatgacctcactgaattatcaccagccatcgctttagcctaggcatgatagtcttcaagattaggacatttaataaaaaagctaattctagtaccaaaaaaatccaaaaacttttaatgaccaaagcaggaatctacctgactttgcaagagattaagaacaccagaacccacaaactgcttcgttgaagcctgctgaattactgcagccaatgcgcgcatggatcccatcatgggctgagagatacgaaaaacaatcgatcagcataatgtttacgtaacttgtagcttggattatttgaagaaagacagacctgacagtaaaaccataatccttggatagaaagtcttccaagtcgaaattgatgttccaattgtgccaccatggcttgataatcctggtaaaagagaggatggttaatactagtgtaacaatagcaaagaatgttgtcaaattacctcaaagctaacataaaatgatatcctcagtccaaaaaatgcatgacatgtgttagacacgaaactcaagatgtgaaatggaaagaaaagaatcagactatcagtttattcaatgcggcaatagtaagagagggattagagagacagtaagaacttggaacaaagaagacagtaagagctatatgtgtcatcttagatattcatacatatgcatatacacacactcagaaatgtgataaaaaaacaccaattcagtggacaagaaagaaacccaataaacaaactaagagcattctaaaatgagctttccaagttcatatttttagtttactgagtaaatccccaaacttgactattagttaaaaaaatccatatccagttcgcaaaatcccccatctgtaacagaaagggaacgaaaaataactcaacaaacaatggatcacaatttccacaaagctagcaacctatatcacatacaaggaggagtgccctgagtgcagccgcgaatgcatggttaactagcccgttcttgaactgcgagcttgactccacaaattggtcaatcagcagataatattcacataaaggaaatattcttttcgccaattcctgcaaaattatttgcaacggtcaatatatatgagaagagccaattaaataaagaattacaatgttaatccgttataacatctctaaaaatcctattcaaaagagagaaccatcctagacataacatagtaatgcatgtgtccattttattggacttcggagataattgaactttcaagaagtcagaacaccaatgaaatgcatcaagtttcataaacataaatatacactttgcaaacatcactgtaacagtctcaatatgtgaaagactttgtacatacatgatacatatgcactaattccggtagctctaagaaagaacagatcaagcatggttagaaatcacagattttttgcagttgactactgtagaccatcatgataaaaatgtttgggataggaaccaaaagttattgtgttgagtactacttacctgtagtgccaaatccattgatggatcaacttggaaagctatactatcctccttcccatggaatcttttaattgaaatatatctcccttcaattccaaccaacgcagataagagatcatcaatgacgataagctcctgcatgccaaaaggaataaaaaacagttactgaaatggacataacaaaagaggtgacaccaattctaaacctaggctaggaagttccacaattgtttagctcaggtcaattatcctagtctatgccacgaaaacgagaaaccaacttcacctacaatgatgccaacttgtaaaaactacacaactcaaacccaagctttaaggaccccaacactagtttcaaggttacataataacaatctcacagaataagtggaagccaagaaaaaaagggacagacttgctttgtaaaataacacaaacctgaaccggtgtgtcatagcagccaattgcctgctctactccagaactgctgaaagcaaaatataaaggtcaatgactctttagaataagatgaaaaaggaacagactttgggaggttaaaacagagatgtattactaatttttagtataaaatttcaaaatacctagacgagtctaaagtaaacctcttagaatcagcaaacttggagcttgccctcgtttcctgagataaacccattgtcaaaactactttttctcagaagttaccaatgttcacaattaaatagaatttgaacgaattagagaactaaaatcaagcacatctgaagatcgagcacctgatggaagcgaccagtgagaaatggtctgtcttggttccaacgaggagtcgtagggcacgagattggcgtcattgattccattgcttcgctcccagtctctggaactaaaagtttaaacctttatgaaaaagaagacacagatcagtcagacagtcaccatataccgaaccatctccggttttccttaaaatgtccggttttaattgaaccagaaatttccagatcctggtttcaaattcgaaattaaaaaaggacaaaaccatttttttaagtaaagaaagaaaaaaccagccattgctcctgccctgtcctccacctccagctttgaaattcacagaaaatgattatctcttttctattttattggcttctcaaaacgaaataacgaaatcgcctcctcttcttctcctcctcgacctggaaatcaatctttcgccgccgagttcttctctctgcggcggagaatcaattagcaatctccaggtttttcacttcaaaacctttccttttattatcaaattttgttcctttttagctttaggatttgatatttctagaacccagaagaaactcttgcccataacatctctatatttattggtatagaattaggtgagggaaaagagg

SEQ ID NO: 539 - DNA, 3000 bp, Arabidopsis thaliana
gagccttttaggcagagatgggtactaaggtgcagatgagcacggcttatcatccacagagagatgggcaatctgagaggactattcagacgcttgaggatatgttgcggatgtgtgtcttggattggggaggtcgttgggcggatcactttagtctggtagagtttgcttataacaatagctatcagatgagtattgggatgactccttttgagacgttgtacgggaggccatgcaggacaccgttatgctggacccaagtgggggagaggagcatatatggtgcagattatgttcaagagaccttagagaggatccgggttcttaagctgaacatgaaggaagctcaggatcgaaagcggagttatgctgacaagaggaggagagagcttgagtttgaggttggggacagagtgtatcttaagatggccatgttgcgaggtccgaacagatctatctcagagactaagttgagtcctaggtacatgggtccgttcaggattgttgagagggtgggaccagtggcatacaggttagagttgcttgatgttatgcgtgcgtttcacaaggtctttcatttgtcgatgctgaggaagtgtcttcacaaggatgatgaggtgttggctaagattccagaggatcttcagcccaacatgactttggagacgagaccagtgagggttctcgagaggaggatcaaggaacttcggcggaagaagattcctttgatcaaagtcctgtgggactgcgatggtgtgacagaggagacttgggagccagaggcgaggatgaaggcaaggttcaagacgtggttcgagaagcaggttgctgcatgagtttgcctttccttggtttccagtttcagtgttgttgagtttttgagcttttgagttgttgttcttatttctcttttatttgtattttcgtttggagttgtaacgatcataacagttgatgattaataagatgagtattttttcttggatttgacttgagttgtcttatttaagattgtgttgtgcggtttccaaaaatgaaaagtttcctagaaaggacttgtctatttttggaaagtttgagtaaacaacctaagagatccgtgtgtttacgagatggccgggagttggtcataaggatattctcgagggatatgatggatggtgagacatagaggtgtcttacgcgaatccatgagagagtctggagatatgctcggaagcgtttaatattgttgctcgagggacatgaaggtcccaacgactcgtgaggagcggggtatgctcctgaggtaccggtaactcgagggacatggtgtatttagagaacgaggggtacggtggcttcgggtgacgatccgagagcacgctttagggtgacgacccgagagcgagttttgtggtattattttcgccaagtgtcgtaactcgatgactttgtggctgagagtgagccgacacaactcagggtttgactttgagtggggaagataatatgtgtgatacccgagataccgtagccgaggcctgagagtgacggtttatgctcgaagattgcagtctgagagtggagagtgagttgtgagcaacaatgactagtaaatcgtgagtatattgactggatagagagacctagagggggtctggttgaagggagtgcagactgtagtgatggttgcacggagttcctcggagtggaagggtgaagctagattcgaggacgaatctatgttagtgggggagaattgtaacgcccgtgaactggaaaatcggttagggtttgtttttaaatcatccggtttaattggttatgttaattggaaaccctagagtgtgcctataaaagaaggaaactcgaaattagggctttagttagccacttttcgttttataaaggagaaaaagagagttatttccaagtcctttatagttattctccagtttacagaattggatttggattaaaattggttgagttattcgcagtttcgtgagacacgttttctcagacgcgaattaggaccagcggagattgaaactgagatcgtggtctcgtcttttttccgatcggcacgagattttgtgggcatctttgtgacgtctgcagataggattttaccggagcgattgaatagttaacggttagcttatattttagggtttcgtttttgagactgcttgtttctggtttttcctgtccagtttgcttcaaggttgcttttggttgtggacttgttgtaggacgtttctgaactgtttcagacgcaaggagagtctctcctgggtttaattggtattagaatcaatttgttaaggtgagtgcgtgaccatgaatttatctgagcgattgagttgtgtgatgatatataggtgtggtgaatatgttttgggtgaattgttcaatgactggtttgtttgtattgtattcgtgattatatttttttatttgcttttgtgtatagctcgtagatgggagaatcgcctcactaagtatttatgataatacttaagcatcttattgtgttgttgatgcagtaaaaataaagtgtgattgtggaatcatggcaaggaagagaggatgatgtaggaactcgtttgttttatgttttgtgtttttggttattggaacccggttaggattgtctgttatttttggttttgttgatcgaattatttatttatttataaaatagtatttctgatttgcggtttaattattatgttattggttgatttaattaaatatttaattatatatatatatatatatttttttttttaaatgggtctggttgtttcacaaagatatctgagtcatatttggggaatgctgacattaatactttcgataacaaaaagaaaatacactcattaaacagaacaaacctcagaaacagaatttaattaaaaacccacaaaatgaatctaagatagtttgctttacaattcaaaaacccgtctctgtgattcaaaatccctaaatccagagatcgaactctcgatc

SEQ ID NO: 540 - DNA, 3000 bp, Arabidopsis thaliana
tttactctattaagaccagaacactctgtttgcttgaataacaaacaatttaacaataaccaaatattttgtcatttcgacatatgtaaggaacgtgagttggtttatactctataaggaaaagagttaccaatgaacaataatttcctaattaaaaattagtaaacgttaaaagtatttttttgtcattccgacatggcctcgtttttttcctcgaaaatttagaaataatcatattatttttacttacaaaatacatatatatatatatatatagatatatataactatagttagaacaactatattgtcgtgaataggtaaatttgggaatcgtgatgatatataatttggatccgtagattgtaggtgatgcatttttgtacctaatctttaattccaaaataagtggatagctctatatgaaatttggccctactttatttgacatgaccttttaaatatttgaaaagccatgagacaatttatttaattttcataaccgtgataataaaaacaatttgtttgtaagaacaattacataacaacatttatctaaattatgagtctcgtcggcggtatgtaaaatatgttaatattatcctttttctatgtaatagaataatagattatctttcttggttggcactaaattgcacgttaaatacttgaaaactttgtatgttgaaatagtaatccaattttaacgaaactttttattttgtaaagattttgatgggctttttaaaacaatttctacgacgtggacagactttggagtttgtatgattaattagattcagatcctcacgtagattgaataaacaataactcaataattgatccttctcaaattttaataaaataaaaacattttttaataataaaataacaacattacaaaataccaaaatatgtagggtaatagtttttgctaatatagttattatattattactaaaatataaattcacatgttaatatttgttgttgacaaaaacaaaaacaatgatattacaaaaaaacaaatagggtgattaaacgctagaagatccgtaaccattttgatgacaaaaagatatggtactaagatgaacacgtttttgagaatattcaaaacaaattcatttccgaaagattatcaattttcaagcatacagtatgatctggtaaactataaatggtagaaccacgataattaactagtcgattctatatgttatgacatagacttagctaggagcatatccggcagaccggcactaatctaatgatttcatgagttgttattatctaaactaattaacaattaatagaatgaaatatagttttatatttaagtttttttttttttttttttttttttcggaatatcaggaggttctgggccgaaacccgtaatcccttcaggcctgaaaccacaacatgtaatattagtttcgtcccaaacatcactcgaactaacgacctctaagtttcgcctaggatctttaccaattgaggtaacaacgcttggtcaagtttaaatcattgttgctttctgtgagattttgatccctataacctaatttatcttatgagaaattaaccttttttgataaaggataaggaaaatagtaaccttgtataaaaaaattcattgccattttcatatatatatatatatatatatatatatcctaaaatgtatatctctaataaaattagaagaaatgataccaaaaataaaggtgaaatcatgataaaattttgtttttttttgttttggttcattgagtttgccattaacgctttttttttataaataatttcgtctacacaaattcatccatataatattttcttttactgcatcagagtttcactatgtatttaggttttttatgaattttaaaaaagttcagcatcaaggtgaagaaaattccaaaaaaataaataaaacggtgacccaaaaaaaacttgttgtcttcaaaaccaaaagtactcgacaaatcaaatagataaatcatgaatcttagtacagtcaggttttatcgtctacgataagttccacaataaatccaaacactaaactgttcagatctcagatagtaactttaaatcaacggctataaattcgccatttgtactttcatttacacaacagagaataatacatacactctatctctctcctattcgtaacttatatttctctctctactgtgtttagaaattggaatcttctctcttctctatctccctctctcttaaaaagggaccgtacacgtctctctctatttccagtaaaaaatcgaaatttcgtataatttcctcagtcccgtaattttctccttttttttcttccccaattccttcaattttcgaattcgcctctctgtttcgttcctcgtagacgaagaagaagaagaatctcaggttttagctttcgaagcttccaaaattttgaattttgatcttctgggctcttttgtaaatcagactgaagatatttagattacccagaagttgttcaaggtaaagcaattcagatcagatccaccaattttttttttttttttcatttgaagtttttgtgtttgttgtttgttgttgggagatatttgaaatctgggttattaaagttccgacctaatttcatattgtgctattaccaaaaataggaaattttgagaatttggttttatgttgtcatcatttaataatattagccttttgtgggatttgtgctttttgttgtttgtatcaaaagtctcagatttggattcactttttgtgtgttttttatagtcaaagctgattcatgctatacattacacagcttcactgtttagtctcagctctgttttcttgaaaacaggaatggtttcagtggacagcacggaaagataaaagagacttttttttccagattttgctgatccaaaatctgaatagttgttcatgttcttggatcaaatctggaaagaggaagtttgttggatctagaagaagataaca

SEQ ID NO: 541 - DNA, 3000 bp, Arabidopsis thaliana
tattatttttaaattgatatcttcttaattttttaaaacatgagacaagtagaactctagtctggtgaaaagctcacaagtaaaacatgaaaggagtgtcttaattcaactttgttttgtcggcagtacacatcacaatgtcatatagataggttgtagacggactattttctgaattgaactgggtcgtgtttgtagactatttttttttttttttaattctatcgactgatccggtgagtttcaataaaagcacactgaaatagttcagagagaacgttttttcgaaagaccaccacattatatgtcctaaattttaaatgttttctaactaataacagggttaatcagactacatgtatttatgattattagataaatcaattgagccaaaacttaactaatagattttccaaacaaattttccaaacaaatgtgacagattatttattttacaaaaaaattgttttacattaaaactttaaataatttctacaccgaagaattgaatttgcagcacaacataagaaatcatgaatgatggtatggcatgcatatgttaatcctaacaaaattcatgattccctatccacgcaagctagcttgcttgtccaaattagatttgttcaactgcataaacaaattgtcaatttccaaagaggcaccaaaagtcaaaccataaataggtagtttggacaattattggggatataatggattagatcgtagattcaggagaatttaaggcaagtaagttggttctctatctaatgttccaagggtcttatctatgtacttcgtttcgatgattaattgatgtagttagtagtttcaaattccaaacgactatttgtatgtacaattacatatggattaattgtcagataacatgttgaattctaacatgtttctgtctatccgattttagattaaagttgtttatacaaaattttagacaacacttaaattagtactatcgttagttatatagttccattaatcatttctccttctgtatggtttatttggacagatatgtcattaagcgtttaaaaatatttgtagatttgataatttgtcaaaaatagcatttattgatattatagttgatccgtacgcgttacgaattctttagttgacctttctttttttataatctcctaatatttaaaattcagcagcagactgatgaataaaattaaatacttggttccatttctagatggtaacaggtacaaatatagatcctcacgtaagaataataacaacggaggacaaaaacgttaaattatgattaattaaacatttaattaaaagtattagcaaactcaatcaaagaatgactaaaaggttctaataacttgtgaggtatttaaacaagttaatgtaaaaaaagaaacaaaaaggttgaaacgtacggttttcatccaatgattatgaatgactataaatgattgttttttctacatcaaatatggagttccatcgtcatccaattttcttttggttacgagtgaaaacttcttaaaacacccgaatataggatctgattgataaccaaaagttgtacaagttttttagctgttaactttatcgaaatagtgcaaaactgttaaaagagctgtataaaaaaactgtacaaaaaatctaagaagaaaactttttgtaacgtttttgataaagtttttgtgattgataactatcaatactgtacaaagctgtattgtgttaccattcaaacttataatgttatagtcttggagagatattttttttactcaaagatatgaatttaagttaaaatattccataatccaaaccagcaatatatacacattaatataatttaaattgcatggaattcaaaataatacttatcgtgaatccatctagatacgttgagataagggaccaatcaacaagagaagacgtcacttttacaagttgagaataatctttcagagagaaaaaaagagtaactgtcgatttttgttgatccaaggtaacgtatatgtcctgactcagattattgcttccaattatatgtgaaaagagctttctccacattgacatataactaggatcattcgctatagacgattaatcgttgtttataatttgttataaaaaaaactttggtattttaaagaatatgtcaatatttttttcatactacagtatttttaattcgtcaaactatttaagaatacgctcatgacaaatgatcatataataataatttaaatagtacttgtatttattttttcaagaagaaaacttagttgaatgaaatttgacttaaaatgatataaagggtttgaatggtaaccattttaataacaatacagttttgtaccgttttgacagttaccaatcacaatttttttatcaaaaacgttacaaaaagtgttttactctcagctttttttatacagttccttttaacagctttgtactattccgataaagctaacaaataaaaattttgtacagcttttggttaccaataaaacccaaagtcttacaaaaaaggtcttacgcgtccacgttagctttccaatccaacccttaattagaagtcttcaccatttgctggttaaaggatattttttcaaagtgtttagcattttgtatacgtcaaactattttagaatccagatgatgaatgatcatatactaatacttagctgtatttttataatttaaaacaacaaaacttggtttaatgaaatttgacttgatcttgtttaaaaaaacgtctcacgtccacacgttagcttttccaatccaaaacccctaaagagtagaaaaccaaaataaccatttttaattcccagcctctttttatacgtagtctaaattgacaaacacatcattcgctctctttctcttctttctctagctctcttggttttttgctaaaaacagagcattttctctctagctctcactgtttctttaccataagtttcgtcatattagtacatgcaagtgtaaggg

SEQ ID NO: 542 - DNA, 3000 bp, Arabidopsis thaliana
aaaggcggcacttagagtggctcatcgggtgcttggtgagagtaggggaggtgataatggttcgagaattagggcgaacgttgtggctcagctcgtgtcagatgagagagttgttgctctctttgctagtgaagctgtgactaaggagaggaaggcaatacattctgttctctggaacaggtatgtttttgccattgaactttcatctcccttggttaacattggtgtgtcatatttattgcatcttagttaactgagtgattcagcttggttacagtgattgataggttttgttgttgttttcttgagtgtatgtcttggggatctaatctgggtattttctgctgtttacagtgcttcagatcatttccgtgctaaagattatgagacaagtgcagagatgtttgagaaatcaatgctctatattccacatgatatagaaaatagagttttcagggccaaaggcttcagggttttgtgtctttgctaccttgggctctctcagctggatcgagctcttgaatacatagaagaagctgaaaaggtatacatttatccatggaacttctattttcaacggtcctagttggatctttcaactcagaattgctaactagttttctgtctctgcagcttgagcccaatattgcttgctcctttcttaaggtagactgtcttttcccccacagtacatgcttattcaacatatggccttcggctacctcgccatatatatgtatctggagattgtttgagaaaaattgtttcagcaacttctctttgcttctgattcttgcagttcaagatctacctgcaaaagaaggaacacagttgtgccattggtcagatcgatgcaatgacgtcctgccttgatttttctccagattatctttccctttcagcgcatgaagctatttcttgccaagcgcttccagttgctgttgcttctctttccaagtttctcagtttctatatctcaggaaaaaaaatgccaaccacagaggttgtggtcttccgtaccttagtcactatattgactcaagacattggcagcgaaaccgaagctcttaactttatgttgcaagctcagagcagggcttctaagcttgggacagagtgtttctttggattaggagagactggaaagcgagaacagaattggtttgctgcgacttgctggaatcttgggtcaaggtgtgggaaggaaaagaagtatgagctctgtggtgaattcttgaggctggcatctgaattttatggctatatagatactgatgagtctggagaagacaaactgatgatttgcaggtccataatactaagtgtcaccgctatgattgctttggagaagcaaaccaagagcgcactgactgaaacccaagtgaaacttgctgcagaattgctcgtgagagcaggaaaggtcttatcctcctctttattaatattacctgcagagttttacctttcagtttcactgatgtttggttatatatttgcagattatgtcttcttcgctctcagatggtaaagattgtatcatggagccagaactcatctttatgtacactttacttgcgtatgacatacacggaaggctcaacaattcggcattccagttacttgtggtaaagacgtttgctggttccaagtcttgtcattacaactatcttctccaacttggaattttcgcctctcaaagccctcagtccaacccggacgtgtcaacatttgctcttaacgaatgcctatccgctctgatcgcatctgcttcaccagagtacccaaccatagctcttataatcaggaagctgatctccatagccagcgtccacaaaggcgatacagacgatgaagaagcaatcttaaagatgtacaaacaagcatacagaatcatggttgggttgaaggaaggggaatacccgactgaagaagggaaatggctcgcaatgacagcttggaaccgagcagcgttgcccgtgaggctaggacagtttgagaccgctaaaaaatggctgagcatcgggttggaaatcgctgataaggttacaggtatggatacttataaagcttgtatgcaggattacttggctggttttcagaccaaagtttcttctgcttagtttcattcatattaactgtctcattagtttaaatgtccatgaaataaatctgagatatagaattgttgaagatgtttagttcatatagtacacactaaatcccctagaaaaactaattaaaacatgtaaaactatatttctaatcgcttcttgcaaacagaatctgctctaagacatattcatctctcatgggaattatgcaaatcttactaagatcaaaattcatttgaccgtagatttttatgatggaaagagtttgtggtcgtgtagagttattaagaattcacttagttttaggtggaggcctaaacttaagaaaggacataagatactgactaagtttgatcatatgagatcgtttacttttgagatgaaacgactttcacaattttcctctgcttctagatttatatctgtgaccgtctgattatataatccttggtacttgttgattagttcttgtcggcaaaggataatactctccaaaagctatgggattgaaaggtgtttgttttcttttgcttaaaattgacctttgacaaattctgtccaatagaatcttcatttttcatattgttcttcttactttcgtaactaaaataataactttgagagaaagataagtagccaacctttagtactccacaacgaaatttctcttaaattgtaatcggttgactaatgtcatcctcctaaaaatttcgttaactttgaatttctctttttcttcttacgattttcttaaatatatgtgaatagaatagagaaaatgtaaaacacggcatgtgtaggctataactgtttatataaaataataataatgatgtgtaaagcaacaaacgtgaggtctctccttcctctttagttggaaagaatttta

SEQ ID NO: 543 - DNA, 3000 bp, Arabidopsis thaliana
ctctcaagtgagaaactctgagaaacccataaaaacacttgtatatcatttattggtcaaatattattttattgttaaaatttaattatataactaatatttattaaaatactaatatctttcttttttgagaaaccaagaaaatatctcactgatggagatgcccttaataattctcactaattcaagaatcacatgcataactttttgctcaaaaactctgcacgaacaaattagattacatatgacatatctacaatttgttcctccatttaagaaatcgaaatgagaaatctagttaaattcaaattttgtaattattactattaagttgaaaccattttatggcattggaccaatactctagaaataaaccatcattagttagtcattgctaatttatttatggcaatgatatcatccactatattatctaagtacggctagcttcaaccatccctaattttcttaacatatatttgatgattacaagtataggactaaattatatggattgcattatagtgtaatctgctcaattctttattttctaatggataaaagaatcatttttttttcttgtttcttttcttttgtgcaaaggataatgaatccttctttagttctttatgtttgggataaagttgacgcaaacgttcattctcatgcgtacacgtttatccgatgcataaaaaataattccgacgatgtatcatttaattaaacatgcttaattttatattgatgatgtttctgttctatatattgttgcgtttaagacttcactacactatattaataatctagaaaactattttttatatagtaaatgcacgttgtagttgataaataatggtagtctgacaataagtcgacgaagattgattcaaaattctatcctagaaccttgatgtccacgttattaatgcaactaccctaaaagtttaaatcctagatccttcagatctgcaaccatgtatatggtatggcctttggaatattcaggatattcccacggtgctcttgcagttgtgcccgtcgcttgctctcacccgcgaacggcccttaaatccaaactcatatgatttgatttcaaaagcattccataaaactgttttcttgtatacaaagatataggttatggcttgtaccactagcatccatattccgcaacatgtcaacgaagatttctatagttttaacacaatcattttttttgtagatatcttagggtgtcttcaactccacttaaattttccctctatatttattagagtaaaatcatttttaattccacactctatacatcattctaaaacacagtaaaggatatgattactctatatatatgtggagtaactctaatgtttactctattctttttagaataaaatataataaaatgatacatttgagaaaacccctactctattttagaattactatattctagagtaaaaaacatacattggagatgatggtcttttagctagataggatttaggagcttccgcttgatcaaaaaaaaaaaaaacagagagttaggagcttccaaacaaagttcaactatcgtgagtacattaactcattgcggatgttaatatatcttagttgtggctttcaccattatactcaaaataaaagaagtggagacactaagatgtcgactggcctatcaaatgttgaaaaaccatcaaaacaaagatcgagttgattaataattatacagttgtggcagattttaaaactaaccccacaatctattaaaacttgagagtgttccttggaatgaattcaacatgtgtattacaacacaatcaagaaattaattcggtaggaaaccatgattttgatgagacaataaacgattggatccgatcaatttccccataaatttttgcaataataaaatatgtcaaggtcaggttccataactaaaggaaaacaatatctgcatttctttatcgtgtttctccatcttgcatgaataagaagaattgttaaaaagtgaatgcataccttgttgatctaataactaaaaaaaaaaaaaaaagagaaggatcaactgatttacaccaaagacatcttaatttgattggatctagccagtagccacctctcataaaagtttaaaagactttctaaccaatagatgttgttttttgttttggttttaatgttaaatccaatagattttgttcttctcttgaattgtgtgatgtttcaacaagtctggcaaatacacagtggttcgtataattggacgatgtctaccctagtttgggctcatttggtttcttgttgaaatccagttttgggaactaaaaatcattataaaattttaacaacaaaattttcatatctagaaactaaataaacacacatgagaagtaagatttcaaaaatatctgtaattgagttagaatcaaaacaaactttacaagatcatgtgaaaaaaatatacatatattatttttatataagtatatcggacacagttgtaaaatttgagagaaattatttatgaaaaatcaattcaaaataatatatataaaaaacaaatagttttttcccccataaaatatcacgattgtatacaaatttgttgggcaaaaacaatactatgaaaattttcataattagataatttatttatgcaagtttttttttgttattgacttttttatttatttagaagaatatatccttatgaaaatcataacaaagaaagagagtttagttttgcctaaattaggatcaaataaaaaaacaaaattcctgacccataccactctacgacctccctcaaaaaaaaacaaaaaagaaaaaaaaacaataaaaaaatcgactttttagcatctgcttgagcgcgagaggttcatgattccaggaatctcgtgcccaattatatagctttccatttctgtggctttgtaatctgatcggaaatcgaaaacaaacaattttattttcttaaaaaaacaagatcgtggaggagag

SEQ ID NO: 544 - DNA, 3000 bp, Arabidopsis thaliana
gagatccaagatggggaagagggcaagagactccaggagaagatccattgctcgctagtaagtatgcttcagggtacgttaagggtcttcaagagactgacggtggcgattctaaccgtctcaaagtcgccgcctgctgcaaacactataccgcttacgatgtcgataattggaaaggcgtagaacgttacagtttcaacgccgtggtaaaaatctaaaagctaaaaagacattttccagtgttttaactgtttttgtcaattgtgtatgtgatgttgtggtttatttggttaatccggttcaatggtactaagttcgggttgggtacaacatttggttagaccaaatacatttttgagtgttttaagtaactttttttgtgcgtttgttttgatggagtaggtgactcaacaagatatggatgatacgtatcaaccaccgttcaagagttgtgtggttgatgggaatgtggcgagtgttatgtgttcttacaatcaagttaacggcaaaccgacatgcgctgatccagatctgctctctggtgttatccgcggtgaatggaaattaaatgggtaatgatctgatctgatccgatcagctaagtttaaatccttttcgtgtgttttggttttgattttggttctatttttataggtacattgtttcagattgtgattcagtagatgtcttgtataagaaccaacactatacaaagactccagctgaagctgcagccatatctatattggcaggtttggatttaaactgtggttcattcttgggtcaacatacagaggaagcagttaagtcgggtttggtaaacgaggcagctatcgataaagcgatttcgaacaactttttgacccttatgcgtttaggattctttgatggaaacccaaagaaccaaatctatggcgggttaggtcctaccgacgtttgcacgtctgcgaatcaagagctagcagcagatgcagcaagacaaggcattgttctactcaagaatactggatgcttaccgctttctcctaaatcgatcaaaacactagccgtgattggaccaaacgcgaatgtcaccaaaacaatgattggaaactacgaaggcacgccgtgtaaatacacaacaccactacaaggactagccgggacggtatctacaacatatctaccaggctgctccaatgtagcttgtgctgtagcggatgtagccggcgccacgaaactagcagccactgcagatgtgtctgtgcttgtgatcggtgccgatcaatcaatcgaggcagagagccgagacagagtcgacctgcatcttcctggacagcaacaagagctggtgatccaagtggctaaagcagcaaaaggaccggtcttgctcgtcattatgtccggtggaggtttcgatattacattcgctaagaatgacccaaagatcgccggaattttgtgggttggttatcccggagaagccggtggtatcgccattgctgatatcatctttggccgttataatccaagtaagagactctgtttcaaaccggtttttgtaattgcaaatttgaataaaccggttttggttatgtaggtgggaaattaccgatgacgtggtatccacagtcgtatgtagagaaagttccgatgacaataatgaacatgagacccgataaagcaagcgggtatccgggtcggacttaccgattctacaccggagaaacagtatacgcattcggagatggactcagctacaccaaattcagtcacactttagtcaaagctccaagtctcgtttctctcggtctcgaagagaatcacgtttgccgatcatcggaatgtcaatcgctagacgcgatcggaccgcactgcgaaaacgctgtctccggcggtggatcggcgtttgaagttcatatcaaggtacgaaacggaggagatagagaagggattcacacggtgtttctattcacgacgccgccggcgattcacggatcgccgaggaagcatttggtaggattcgagaagattcgattggggaagagggaagaagcggtggttaggtttaaggtagagatatgtaaagatctgagtgtggttgatgagattgggaagaggaagattggtttgggaaagcatcttcttcatgtcggagatttaaaacattccttaagcattagaatctgattctatatttttatttgaggaagaaaaaaagaatattaatatgcttaagcttttgcaagttggaaaagaaaagtaataaaaaaaagaaattgtgaatctctttaaaattatagcattagtagccgaaaatgtggggcatatataaacataattcgaatatctaaaatatatcatgtgtaattcatgtgtaacataaatctagctaatatcagttagagttagatttatgtttggtatttcaatttaagtaaatttagtctttttttttttaattagttgctcaaactaataattctgataacaagcagataaactcgtagtatatcccgatcaaaaataaattaatttttattttcttaatctaaactaaaccgggttttgtgtcgaatttaggtgattcgactcaaatatgaacaacatttaccagaaatcagggttattattaccggtttattgcggtttacattttaaatataaataagattcacctctaacagaatatatcacgttttcctttttttctgaaactgtaaaactctctcacaaagcaaaaaaaccaaacctaaacaaaaatctagaaagaaagatttccgaaaatctttttaatgaaaaaagagcagacaggacgagaattcgcttttctgaatcctttagagtattgttttctccgtcgaattcgcatgaacacttgagctcaacaaggtcagattctcttgttcgcttttttttttttgatgaagaattcgactgttgtgttgatgctggtgctctgaattttacagacggcgtggaagtggacggtgaggtagttttttttagtttttgaaagac

SEQ ID NO: 545 - DNA, 3000 bp, Arabidopsis thaliana
atatcatatgttatcgtaaccctcgaacctatggttcaactctactcagtcatcgacctcgaacccatagttcgacataaacctgtcatcatgctacatgcttgatcatcgggatgtttagacatgttatacgtatagtataaacctgagctgaattgattcacataacctaaattacatgtgtgttaagagatttgtctgaggtgagaatttgcaaacatgtattatttttgaattattaaatatgaagataaatatacctaaatattatctaatctgtataataataacaatcagaataaatatattttatgtttgtgtcttttcatataaaagtttataaaatgtattttttatgtccaatctgaataaatcttttcctttcaagcaattttacaatagaaaaatatgtttgattgctaaaaaaaaaaaaaaaaaaaaaaaacctttttagtgtagtacttgtctaatattattagtctatcaatataatactactagtataccaacactaatacttttctcaattttcttgtcaaactagattttaacccgtgatataccgtggaaacaatttattttcttaaagttagtatatataaaagtttgcaaattatatctatctataaaataattttattttatagtttacaattcttattaagtaacgtcctgccaaacccgtcctctaaaaaaacttctttattttaataatgttgattttatttatgatatgtttatgaatcattatctaaatattttgtaattttgtaataattaattgctatcaaatatctctacggtttgctgcttataatcgaattgttatagtcataaaaaaagcaatatcaaaaatgataattttgtagtgtttaaatcatattaaatattttgcaatatcaaaaatgataattttgtactatttagtaactaatcgtatagttaatgcaaagagattttgagaaagtagttaaatgcaaacatttaattcaaagatttactttctaattatcaaaaaaaattattaaatgtcagtgacagccactgtaaataagtctcaacttgaagatttattttacaaagtggctgcaaaaatgtatatgtagaaactaatactttgctgaattaacggagacaaatataatattatgttaaatagtttgccatttaggacgtttctacttattagtcttccattacttttttttttttgaacaactattagtcttccattatttaaatacgtttttcttttatcaaagtcatacttaatacgtttttccttttttttgtcaaagctaatactttttcttttcaggatttgacttaaatttgatcgtaaatttttagcagaaaataaatttactctagctaaattaatagttatatatttaaaaataatattaaaccaaaacaaaatcagaaaaacttaagtttaaacttaaaacacatcaaaatataaatagctttgtaaaaccgttaaaaaggaaagaaaatcagaaaaaccaatgtgaaaccaatatgtaatttggtattagttagatttatatttatatagcaattcaactcttaaataacattttagttagtaatgtttttttgcaatgtttgaaaaaaaaaaaaaatgttttgcagtgtttgaaaatctagaaggtcccaagcaaaacaatttttatcaaatcgctgagaaaaattggaaactcagtctagccggtccaaatcagacaaaatctctcaaatcggttaatttctgatttaaaattttatattttctaatgcttaagagacgtatactgtagtacttgggattttggatttaattcatcatcttttcgaccttcaagcttgtcgtttatttttgacaattttcagtttgaactctatgaaattttgattttcttctaactcaaaatcaaattaattaattacattgctagtttttttagttttcaaagtgaatggaatataattagtaatacatatgactaaacatatcaaaactaatttaataagtttataaaacctaagttccaactagtcgttttacgcgctttgatatctatcaaactttgagttatcgcctagcaatattttgaaaatgacttaccctagaacaactaatatctttactcatctaattttccaaattttccttgtaacttgatgctgtaatcctctattttaacgtatctatcgttgtgacatttccctattttcttatactactcagaagatgtatcaattgaatacaattttctgacgaaaaaatattttcttttatatcggctctttgaagttctaatttatatcgattgacaaaaaaaaaaaaaaaaaaaaattttatacatagtttttcctctctaagtatatagaagacaatgataagattaggaccaacaaacaggtcataaattatcagtttttctgccaaatatagcatcaatagaaactccattattgggacgcaatgtgaccacttgagcatcttatcatttttatttcaaaaccaccttattacactgagcttcccttttttcagcaacaaattaatgtcaaatcaattattaaaaatacaatataaattctgggagaataacaagtatttattagtcattacacataaaaaaccgtattttggtgtttcgtagaaagtgatatcatactagtctataatgtgtttcacaaaaaaaaaaaaaaaacttatatcaaaatcaaaatttcatgttcttgaaaagatttcaatatattttttttttttgtcaatcgatattaatatagactcaaacgaccctaccccaaaagatattgtaatttcaatattttattaacataaaagatcgcacacggtacaaccaaaatagttttcgaaaccaataaaaaaggaaataaaaaccgattctttttttttgcaatcccattataaaggagcaacgcacaagccacaagtaaaaagtgaaagtccaacaaagatacaaagaagaagagagaagaagaagaaga

SEQ ID NO: 546 - DNA, 3000 bp, Arabidopsis thaliana
agagattctcagatttatcgaggtgaagaggatatatacattgaagtcctttgtgtttttcatggtttatatttgacattcattagtcagtttatctcaatttcttgtcatagttatttccttgggtttcattatactctcttctctgaatacagaatgctaagttttcacctgaaatgagtcgatagattgtgtagtctgaagtgagtcaatagtaactgatcacaatggacagaacataaggatttttaggatagttatctgacaattagttggtaacttctgaggttgtagatatatgtagtgagtattctaacacaaccatgatgactgcaaacactctgataccattggaatagcattactaactgctgttggaacctctttgttgcgccgcccaggttactgaaattcatacccaggaaacttgtggtttcatttttcctccttataacatttgactccaagcatgaatcctttttatcaccaatgctgctgcattacattctcttattactgtttctctattgtatcctggttcaagctttgaaaaatatcatttggataaactcttatatttacgttcaaccttaacatcaagaatatgaattacattgaatccagttggaagttaatctttgtggtttatcaattgcagggacaacatgaggttccacaaaactttaagaaactgttgagttatagcctgggaatccttgtttctcaagacaaactcaaaaaggtaactagtgttgtttttcttaatgcgcggtttgtcacaagcctatctacttttctccatacccccaatatctatatgacaagatgtagtaataataaacctgagttatattatatgataaactcaaaaattactttataaatgcaggtacgaaatcgttacaaaatctcagttacgaaagcaattaagccaacactcaccctgcgtccaaaagattccacgaagccaccagagttaccaagtacttctgtgatattaacatcaaaagaaacacatgagatagacccagcagcaaatagagaagcagaaggaatgaatgagttggcaaaagaaaacaacgtaatcttactccttttaattacatgttgctcatccaatttacagtatcatagcaacaaaagatatgatcccttgtggttgatcaatttcaagactggtacgaggagcaacaagactttaggatgtttttgagtgagtgcctgataattctcgtttctcaaggcaaactggaaaaggtatatttttcttaattgctcagctatttattgatgcatcatcatctatctataacaagatcatttgtaattcttatgattgattaaaatcagaaaatctcccaaattgcaggtattggatcgctacaagatatcagaattagaaaacaaagtgttggaagtagcaccagaagttgtagcaatgaaactagcagagtcagataacaaaaggttgatagcagcagaggcagtcgaagaagaagaacgaatgcacaagttagtagaagaaagccacacgatgcttcaattatgcttagagatccaccaacaatgtaatctcaacaaaactcacatggtacatcaatccatcatcatcaccatgatcatcactgtcttttgctttgtttcttgcaggtgctcttggccaagaggttgttctactgtaaaagaaaaccaagtatctatctagtttgcttcaatctatattttacttaactaaccacttgagttttgtttttgtagttcttaaacacaggtttatatggttgtaatggtgaactaatgttcactgttttgttcataaaaagatagctttttttttttttgctaaaaaacaatgacgtgtctatggagtcttgtgaatgctttgctacgtcataaagcatcaaaaggtgctggaaagaataagcttttccaaaagaaaatttggtctttttttctaattaaaaagtttggtattggcgtatggaagtacaacactactactcatatttccacttgaaaacaacattttgtgattgtgatttgatattttctggtgtgtgttagtatgcaattgcgattcattattcatagtctcttttgacattggtgtaaaataacttgattggtaacaatattttccctactagtttaggaaaagtataaagaggtgagaaaaatctcaaatcgaaaaggaagaggaaagtgggggtaaagttggaaatataaaaattttggaaaagtagaacaattagaaagaggaaaaccctaaaaaaaaaaagagggggactatataactggctaacacgtattgggttgagtctctctctacctcaatttatattatttgcttcaatcttctctttatcgctccaccagatccaagttcgcgagatttcaagctctctaacaaagttcttcacttttactctcaaagctttcatctttcattcaactacttaagctccaaggttcggaaatattttttttacttttctctgcgatttgttccttttcttatgaacgattggatctcgagtctgatttactctctttgcgatggaatttgttctgggtcgttttcaaaattgacgcttgttaatctataattcgtcatcggattcaattagtccgtgaaacccttcaattcgtttatctcaaatcgatttgggttaggttttgatttcgacacttatgttaaaatcatccaaagcttttatcttcgattttggacaactttgtgtatattatatgctttcatggagagatagatgtttttgaatggtatctgttatgataattggatgaaccatatttcctatatctctcctgacatcgaataattcagatattaatgcttgtgttcctctctatatggaacttcaagtttggctattctgttacattcttacttttgcacaactctctctggctataagatttaagaatcatctctagctatctgggttctaaactattgtttcttttgtgtattgttgtagt

SEQ ID NO: 547 - DNA, 3000 bp, Arabidopsis thaliana
tagatttatttgctggatagtatcttgtctgttatgttgatgttcttcaagtttagtctggagggaacaaagacagtttcttgacactccccatgtatatatatatatgcaacttctcttttcttataagtttttttactgtgtttgacacgagctggtcggctcaacctattttagtttcacattctgtgaagttaatcatattcaattgcaatactttaaccacaaactatataagttaaactcaatcaaaatatggtgcaatggttcccatcacaaaaatagaaatggactattgaatctcttacctgttcgactaaaataaatattttcaaacaagaactgttatagaacaagattttttacctacagatacagaacgcaaccgatccgaaatggacatgcctaaaattaaattataactttaactaaatcccaaaacacaaaccgaaaacgaaccaaaaatccggatttatcatctacgactacaaacattcaaagtagtatgtacaatagatattgggccataagcccattaacccgtttgtgaattttgaaagagctcaggtattggggaaagctctagtctacaaatttgaaattcggaattcgaaattggggaaagtcttcttcatctgtctagagagtggcgtttgatttgagataacgttcttctccaaaattgcttgaggaagtggttttgttgtgtctctctgggtttgaaatatgagcggagatagacttgaatttgaaaaccctatagaggatgcggtttcgaggctcagattctcccctcaatcaaacaatctcctcgttgcttcttgggattctgtgagtttcttctcttctcttcttttttctcggatcgataccgtattggtctcagagatagtgacgaattgttgcttgcttgtgtaaatgtgtagtatctgagattgtatgatgtggagagctcttcgctaagtcttgaattaaactctcaagctgctcttcttgattgttgtttcgagaatgaatcaacttcatttacctctggttctgatggattcatccgaaggtttgcaattttcgcttttctattgtatgaagatagcaaatttaccttttcaatgaaaaagatctgatcttgtatagaatgataacaccttgcttgttaggtatgatttaaacgctggaacagttgatacaattggaaggcatgatgacatttcaacatccattgtctactcttatgaaaaaggtcagctttttacatttttaagtaagtggtgatgactgtttttacataagttgatttggtatcaggttttgagttttgaatctaagactttggtaacgttatgtatactgtcttatactaaactctaagtggtttgatgcggctcaggtgaagttatctcgactgggtttgatgagaagatcaaattctgggatacaagacaaagagaaagtcttgtgttttcgactgatgctggtggagcagtgggatgtgtcactgtatctggaaacaacttagttgtttgtgtggacgcatcgatgcatatatacgatttacgtaacttagatgaagcttttcaatcgtatgcatcccaagtggaggtgccaatcagatgtatcacctctgtaccttattccagaggtaaacatatatagttacaagaatctgtctttggtgttatttggccatagtttacatttccactgagaaaagatttatattttacattgatcaggtttcatgtttggtttggtttctaagatgtttattgttggtattgagcaggatatgcagttgggtcagtagacggacgagtagctgtggatttccccaatacatcatgctccagtgagattaagtaagtccacaatatgaaagttatcatttggctatccactggtttgtattcaatcttttctcttaagatgtgtaccataaattcatggcagatacagtttccgatgccatcccaagagtaggaatggaagacttgatggtgtatgcataaatgcaatcgaattcagtccatggtatatgtctctcattcaccatctaatggtacacatgattgatcatcaaactaactcttttcttgttgccacagtgggtcagggacttttgtaacaggtgacaatgaaggatacgtgatctcatggaatgctaaaagcagaagaagactcaatgaggttcaaacactaaacatgacttgttctctctagattccttcttgttcttattctcctctataataatttgtgttttttataaaagttgccaaggtactcaaatagcatcgcgtctttagcatttgaccacactggagaactcttggccattgcatcaagccacacttaccaagatgctaaagagaagtaagtcccacactcttctcaattcgtttcatcatcacaaacactctcacaatacatcattaaaacatttgtatcaatatatctccaaatgttttgcagggaagaagctcctcaagtgttcatacacaggctttgaaagattcgtaagcttcttgaatctcagtgtctacttgtatctatctagttatttttttgtgtgtttttggtagcacgttttagcttgatctcagaactgactcgtgtcaaccaacatgtaatgattgtatctctcacgtctctttatactacttgttctctaaactttgttttgactttttagtcaactatatgctttgactttaaaataaacagtagaataatcaaattatttaagagttgattaattaaatagagaatctcagaggccgcgtaagatttacgatctgacttttatttctttaagaaaaaacaaaaaaacgccgcacgtgtagggtcgcgtcagttgcacgcgacacgtcaaataaatctgaaccctagatcgctttcttcagtgttctataaaaactaaactccattcgctgacttcgcaaagaagaacactttctctctgaaatctcaaattcatctcttctcttccgatttcgctgaatc

SEQ ID NO: 548 - DNA, 3000 bp, Arabidopsis thaliana
ctcaaactgtagtatagtcgtttatggtgtcataccattcataaacaaatcacaaatggtatactattctcagatggattcttaatctcaaatccacaattgtacatgattcgtaaatgaaacttttattttttaagtgttcatttttacatgcttcgttatagctttttttaaaagaaaaaattggacatcagttttttaaaattgtgctattagccacaactcaataattaaacacatttattacttttttttgtttgataaagacatacgtaaaccatttgttaaaaatatcaagaaagatcaaattgccaagtcataattccatttgtctctacgcatttgaagtcttaattacgatttatatctctgggtagtactagtctatgatctttccgtggaggtggagcggtactctataatttttccagttcactggagtaaagttatttttatgtaagcgtcatgactttttagagagcagcaatgtaacaaacaaaaaaaatataaacaaaactcttatttattaagtagtgcttacattaccctcaaacatccaaaagcttacatttatcataaaacacacgatgaggtgtggtatgtgtcaagtgtcaacatgtatatatcaacaaccacactctcatacgctttgagggtttgtttgagatttagtagaaagaagggaatgaagggatgttgaagggacaaacatcaacttgcgggatgtcgcaaacgttgggcaagtgcttggctgtctggtaaattttcctgacttgcattggttggtgctgtccctggagtctaacggccttggcagcttgtttcaaggtggggcaaacacaatctggctcttcctggcgaagctcgttgcagcactgctggaatagctgttgttcctgctgttgtccctgtgggttctccatgtcgtcttcgaaatcaaactcatcgctacggccttgccttgcttgctggagcatcaattgctggcaagctcttaggtgttgttctttctgaaactccttgcggcatttcctcatttttgggcctatggggttagtggcgtcatcttcttcgaactcaacgacggtgcggtagatggaagcgttggtgaggaggaagcagagagcgagagctgcgcagacgaggaacaacttgtttgccattttttgctatgtgtgtatgttttggttcgagtgaagaatgtggtgaaggtgtggttggtatttataggtgagaaaagagacttgcatggagttcacgtgtaagaatacatgcatatgtttgtttgtatgcgagagctatatgattgttgtcgtgattaggtgttggaaactcaaatgtaaaggaagtgacaagtttccgcgtctacttgcaatatgcaaccatgtgtaactcatgttctgacatgtcaattattttgaaatgactagttgagagtcaatacggaaagagtagtagtgtgtcaataaatgtttttggaggttaattctgaaatacataaaagttttagcatcttgaaaaattacttatacacgcaggtcaccggtccattggatattgtctattgatggtaagacaatatatggataaagataagcttaatgtttttcactcccaaagtaatgtatgtctaagaatgttatggacgggtgacaaaaactagtcctctcacgtttcaccgtgacaaaacatacggacacgagtagttaggatatttagaattattattccaagtgtctcttaaaatacatatgttggttattcaggtatcatatacatgaaaccactttatgaactaccactaaatcggataaaagtgagattttgattaagaaatctcatatatataacactaatttttccaaaaatgcttaaaaatcaaattttgtttttaccgaaaacgaatcttggtttaatttggtaccaaatatatatcactctaaaccgaaccaaaatccaccgcatcgtaaccaaaacaaagctctgtttcgttcaaattgataaaataaaataaaataccaaaccgcaaaattgaaattccaaaatctccaaataaccggaatgcctagctctctctatccatggaaaaaataaaataaatatctaaagaaaagctgctaaagagactgtgagacaaaaacgacgatattttcctcttcctctcattatttttgttctcgccaccgaaacaacagaagttgcagactttatccgaatttagggtttcagctcgttctctcttctccaattatcagatccacgaaactctacttttcggatcaggtaaaatcttatcttcttctgattgcgtttgtcatcttcttaagcagatttcacaaattgcgttttgctatttctttgatttcggtaatttcgaggtgaagtttgttttcattgcccgatccatataattttggagtttgttgatttgttttcgttcgtcagattggtatatcgtctttcgtatgtccctgaagattgtacgctagcttttgtttaggatctgtcgaatttgctgctgactttagaaaattggatcttcctttgatctgctgtggattgatgtaatttgtttagatcatatcctgtaattgagctggacctgcttaactaggttcctgggactaggatacagaacatacaatttatttatgaagatggcatcttgctcatttcgaatcttatgttgcaaatgataattctggagttggtttcttagctgaggttttagtttccccatctggtttatatatcactaatctctagatgaacatggcttgtatttggattgtgtgttttatcttgctatgtgtattatgcgttccctgtgttctttaactgttttctaagaccttattaatacttattttgcttttctcgattgtggtgtagcacttgtttattatttgtttatgagtgtgccaaattcttatcctccgatggccttcatgttcaggtctcagcttctctatcgtttgcccctcagatcaacaaagtttc

SEQ ID NO: 549 - DNA, 3000 bp, Arabidopsis thaliana
gatattgtatttggagctgagcatttgagacacttgaggttgccaactgcttcttctcaagtcatgcttgttatatagttgcattcttacgccattttcagttatatattaagtcataaattatactttaatgtggtgatcaaaatattgtaacttataagatataaaggatcataaatttttgaattaaagtactcctaaatagtgttgaataccttattacggttaagcagctaagaaaatgtaaagagtatgcattaatggtaatctataatagtgaatataatgatttttattatcaaaaatatattaataatgattaaatatagtattatttagttgttaaatatattgtatttttttattttgtaattagttaagggagttgcaattatgccagaaaaaaatcatttcaaaattgtagtttaactagattttaacccgcggtacaccgcggtgacaatttatctttttaaagttagtataactttttttttgcaaattatatctgtctataatatatttttattttatactttacaattattattaagaacgtcttgccaaacccgtcccgccaaacccgtcccgtaaaaaaaacatttatttatattaatgttgatcttatttctgatatgtttataaattattgtctaaatatttttgtcgatgcgggacgttgaacccacacattttttgccagttggttaatatatgtttattttaaaaaacttgaatcataaaatatgacggaaaaaattaagatttttttaaactctatatattatataatgatgttaaacaattgtgatatatcaaactttttataagtttaaatattaataatgttttataaattttatatatataaataataatattttaaaaaataatatttttgcttataaggtaatgacataataactctaaaagcaaggatttagaagatttaaatctttaattaaatatcttcattaataaataattaatgtcaataacatgacattgtaaataagttcaaatacaaaatttatttatttaaacaaaaaacgtttagtaagaataatatttatttaacaaaaaactttgttttaaaatattgttagcaaatatgtttatgctaattttaagggattaatttgaagtttgttgggattaaatttgattgataatgtgattgacaatttaaatcaaaaatttaaagtaaaattaattattttgaaaaaaagatttaacgctaatggcattagattgtaaataagtgtcaagtagaggatttatttgctaaaatggctgcaaaaatgtatatatagatatgtagtaattttatagtttgatgactatttttctaaatataagatatatctattaataaattattttagtcaaattataattaatgataagtacacgtgtcatcaaagtagagtgtcaaatatctcattggtaggcaaagttagaaaaaaccttctaagattttaatggcttttgcctacatcaaataaagttaatatcgatggcctacatatcaggagaaaaaactatgacttatcatcgcggaattttacaatctggaaacagatcttatgagatgcaagttttagccacaatctccaactaaacaaaaatttcatcaactaactttgctttaaccgataggcatagctggcgctaactcatgtaaagctacaagaaaaaagaaagaaaaaagaaagaaaataaacaagggctgcatgagtatacaaataattgataagttcttaaccatgattgaaccagagaagacatggtcaaagagaaaagaagaattgataagtgcgttcctttaggagatcaagctccatgtttccatattcccactttgttaattatgttctttgttaaagacatcgaagtcatgagaaggaactagacttgaagattgacaaaacagagtttatctctttagttattttgtgtgttcttgtgttaagacaaaacacatctctttggctttgaggagagaccacctatcaataatatcaagaatatgaaattttggcttcgaccaaataagtccagcacttatcactactcctacgctctagattaaatctccaattaagctccttgtagattgctataggcggaacatatatattttatgttatgacaaatttaatttatgtcatgacagatttatttaaggttatcaaactgtggcttttgatagcagatttgataatgaaagaagaaacaactccaaagaactttatagtaaaaatatttgcatatatatcatcaggtgttgaatggttgcgtagtatgatgtagaccggactaaaatcggaccagccggcacttaattcatcattcactattgcggactaaagtgcactaatgcagactaaaaatctccacactaccatgcacatgagcatacaactccataccatcacaaattcactactagtctgcagtttttcactccacttcccaaaaactccataccatcatcaacttcataccaacatattattatctgctgcatactacagtacgacattttgcatactaaaatattggtaagtattatctagtccgcattatataaataaccattcaaagcctcaatcttttgacaagtagattgacgatcttataatatatttttatacaacattgatgaaccacactattgcaagatataactttaaaaatcatcgcttgccagtgttataccattaccctttggcacgttttcgaaatgtaacaatgtcttgtccccatattttttatacaacattgatgaaccacactatcacaagatataattttttaaacctttattctctgcacgtcttcgaagtgaaacaatttctttgccaatgtcttgtccccatatttacgtataaatatgcattttacgggcactaattaaccatttcatcaccaaaacttaaaactaaacacaatccaaaagtatttttaagctttcacatacgagagaaaacttagaaa

SEQ ID NO: 550 - DNA, 3000 bp, Arabidopsis thaliana
actggagagattgagatcaccataaatctcaagaaaccaaactcttgatcacggttttgttattttggattcattactatatctattagtagtgaatgagaacaataattatagaaaggtttatagatatatatatagagaaaaagagagagtgaggatggttcaaattatttgcagagattatacttagccttgtttttgtaaacggctttttttggttgggtttttatttttcttgaggcattatccaatattcaagtaataattttgatgtttttgtttcataattttgtgtgtttagtttacaaaaagagcataataataggagggacataagcatgtgtttggtcatttattcagattcatagtagagatgctttgaattttttgttcataagctttgaaataatgttcttcaacgctcacctaatcattcggtcgttcgttcaattgactaaaaggtctttagctttgaccgacagatgcgtattacatatggtattattttaaattatgttttttttgggtgaatttataataacaaaaaaaatcaacaagcagaaaagtttgggcattttgggtatatatatatatatatgcctcatgctacccagccggcccacctcatgttttcagcccaatgatacatatgagcaagaaaaacactgcatagcaaatgattttcatttgcacaaaaaaaaaaaaaaagcaaatgattttcaattttatttttgaaatgaatttgaaaggtttgagactatcgtgaatatatataaaattaaaaaacaacttaaatgaataatcttggaactggaaaacagattaataatgagtttttagtttgaaactacacaaaatagataccttggacttggacagtaaaatatctgatttttttacaaacttcatgacattttccgataattttaccaatattttgccacataattaaaaagacttgtctcaattcgtatcatcagtttttttaaacaactgcacatgtatatcgtttgctacaaattcatagtaatggttcacaaaaatttatagaaatttcagtacttttgttatagatataaattttgaaacgacaaaatgttttgctactttctaccgcaatactgttatctaattgtaattaattatttctaactttgacctaagttataactcaacgacgatactatagtacaagcttattactaaactacaaatttaaacaggggtgtgactctagctagctagtttataataaatgagacgcaatgatggatatgcagctacaagtgggttcataaaatattacatatccactttggttgtggaaactggaaagttatgtaaattttggccaaccaaaggaagcaaagactttgcttctcaactcttcgagtacacttccgagtaagcttccaacatgggcacgtagtggaatatgttgcgcaatcctcttgatgtcataaacataatggacaaaaataatttaaaatttacgtacacatgtttcttaaaactccaaattttatccggaaaaatgaatgttttgaaaagtctaagaacaagtgcgatattatgtgacaaacagaacaaatacaagaacaagagttagatcgtaagtataagttacattttccatcatttggttgtggtttggatgaaatgttctaccgagcataatggcagcgcttgtctaaaggtttcccccaaaatccaaatatcattttaaatcgagagggatcggagtatcatgatcacagttgaatactccttcttttatcaattagacctcgagtaaattataaattccaccatccataagaaggtgataccatctttgggatcgatattatcgacctttagaatccgtttcaagtttggcatatatgatatatagttaaattccaaagtatatttgcaacggaccatctaatgaaatcctcgtttatactatgaagaagttggaaacattacttaacatatgtatgtagacgagagcaataaatttcatcaaagcctacttttctattttggagacaaatttggctgataatctattaatttggcctttgaagtgtttctactttctacgtataagcaaatttcttttaacctccctaaactttctggaagacttaaagtaactaatatcccattcctccttctttggatatttacaaaaatttctttagttcgtctaatttaggattctagacttgtatttgaacaaacccgtagataatttattatttaggatttgaatattgatccgaagccaccccctataaatgatgagtcttgcatgagaactagttcacattgactttgatcagcttggtacgtacctaataacttaaaaagcttgctaattaccttataacttacatccattgaagagataaagggagattgatggcggaatttagaccgatattttctccaatagatcattataaaccggattacatttttgctgtacataggctgcgctaaacaccccaaatgcgcacaacgttatcaataaaaatgaaaaagtaagggcatgagatgattagtttagattatttacatgcactaattctcccactattcaaaacttatgagtatacatttaacatttactaggttttggtttttatttgaatgtttgtatgacgtttacaaggaaaagttcgtatgacttggtataatatatggcattttaattctagataaaatcacatgctcacatgggtaataacaaatcatttattttgccaagtgactgaactatctgacaaaaacctaatattacaaaaacctcaaaatttatcccactatattatcttatttatagtggcattcccactttcttaattatgcatgcatctccgaggcgcacccttgttaaggcaaatatctattttttaaaaatacaccttgtttttggtgtataaatacaagctaaaatcatcatagcaatacactatcaatctacgatcatatatctttcatttcatcatc

SEQ ID NO: 551 - DNA, 3000 bp, Arabidopsis thaliana
gctctggattttgactccaaactccgttcgcctgagaaaggattcttcagagcaattcccgttctgcgtcatatagaccaataaggatttgccacgtcgcttcaaatacgacaccgtgtcatcgaaatagaactttatggattaatcataactttaattattcgtattaagtacaagaatatatcttggattatacttatagaactctctttttttaagaaaaaaatgcataaattttgctaagaattttgttgtagcaacacatcagcatgacataaagcaactattaaaaattaaaactaaaacttatatttaaaagattatgtaataatatagttattaattaatagtcataatttttaacaaagtttcttttaatataaaaattgacatagaaaattatttattttgaagatttttttattgataagatgaagaagatgatccatgcgacatttgctcactagttacgcttccatcattgggagctttgagatgatcattttgaagaagaacattcagatgaaatctctgaagaagacgtagtgctcacagaagaaacttgcacactactttctttatccgtagaagtttgagagctactagaattatcactattttcatcttttgttacacaactacaccagtttcccattaatgtccctacaaacataataaaaaatgttaaagttgctaaattatatcttagttttttttgtaagtgttttcaaattaactgaatagtacttattggtctgtaggatcagtttcgaaaatgcaacaacccattgtaatttaaaataagtttttgtaaatgtaccttagcttgaatctcctcagagtttgttatgatctctagctacacaattcatctttttatagtgagagaaaaatatctcaaaattcaatacaaaatcttttactattaattactttttttttttacaagatcgaatcgacctattattagaacttggatgcatatggatcatgatttatgtcacaaaagttttgtgatatttaatcataatctaaacattttctatgtcttctactatattttgacacttgtgtgtaagacataaatggtaagaggaaatattattgatagtgtttttttttttttggatttgggtcaaaaatattgtggggggaagccacgtgtacaaataaaagtaaaatttagttaagacaataaatatgagagttaatgtatgtatcttagaaacaaaaaaaaaatattaagtatgaaatataaggaaagatatagcaaaaaaagtaagaataaatcaacatcttattatataaaatatggttttcaaagttattaactcataagattatgccacgtgtcaagtctatcgatcagatgttgccatgtgtaagaaaataattaaccattttcttcttaaagaaatagaaatactaaaaaataaattaattaacttttttcttcttaaagaaatagaaaactaaaaaataaatcattattaacatatactaattcatatttctatatctaaaaaatattacattttatttttcttaaccaaaagaaaaattaacaaaaaaaaatcttattatataaagtatggttttcaaagttactaactcataagattatgccacgtgtcaagtctatcgatcagatgttgccatgtgtaagaaaataattaactttttttttcttaaagaaatagaaaactaaaaaaagaaatcattattaacatatactaattcatatttctatatctaaaaaatattacattttatttttcttaaccaaaaggaaaattaacaaaaaaaatatatatatatgttattggtcaaatttttaatatatatggtattaacaaatgttttattattatgaattatgttttgttaattgttaataatttttaatattaactaagatatagatttgatcttatatatatatattattttgacatgaaatcattatcaagtaagatgaagtgtgtaaaattaaaatcgagttttttatgaaatagatagttaaattgtattacaaaattgaatgtataagataaaattttattttttcttctaaatactaaattacaataaagaaaaagtgtgtaggttactatttagacttcaaatatcatcaataagattgaatgggtataacaaaataaaatgcataagactactattttactattcaaaattatatatcaagaacaatgtatcgattattattttactattcaaaatttaaatattatcgataaaaattacatttacatcttatacccgcttatttaggcgggctttatctagtaagaaataaaatatagataaccaagatatattgtaacaacgttacatgtcacgcatccatacagacagagacactatacgttacgaatttcaaatgtaacaacgagtatttcatttttcttctatattcgatctcaattattagattcttttttgtagtaaatataaaaacaatgatttcgattgagacaaaactacaagtgaggctgatgtgaacggggaaaaatagtgacggcttatatctgaattacgttgtgaacacgtttgtttatttcatggattgctaaactttgaggatatagcaaagaagctttaagtaaagcaaacgaatcattaatattttgggaggatgtatatatatatttgaagttgttgttgttgttgtttaaaactgttttttttttcttgtaattaaggttgaaacagattttgaaaggacgttagcacgaaactcgtaaataacgcatgtttattttccaaataaatttataataaaactattatacatcaaaacccattaattcatcatagtggcaaccaagtgtatatagcaatataaatcaattttttaaaaacaacttctgtaaacaaaaggaaagtgaaggcactatgtgtccccacacggttccattgagacaaaggcatatgtatgtgtgtgagtataaatataagttggttcttgaacatcattgc

SEQ ID NO: 552 - DNA, 3000 bp, Arabidopsis thaliana
tcgtggaccggtgtatcgattcaatcgcttatgcaatatgccaggagagccagagcaatgaggatatagttgactggtgggctgacgatttagctgttctaaagattgatatgtttcgacgtgtcttggtcgcgatgatcgctagagggtttaagagatactcacttggtccagtacttaaactctatgccgaaaaagctcttagagggttggtgagattcttgaattttttaacagaacaatgtgtttgcttactttaaagaataatgtaatgtcggtttctctgtgggaaatgcaggacatttttgggaaagaggcaaagaagatggaggcagaacaagaacatgagaaaaggttgatccttgaaacaatagtgagtcttcttccgagggagagaaactcagtgtcagttagttttctttcgatacttttaagagctgcgatatacctcgaaaccacggtagcttgcaggcttgatttggagaagagaatgggattgcaattaagacaagctgttattgatgatctcttgattccttattattcattcaatggagacaacacaatgttagatgttgatactgttcaacgtatcctcatgaactatcttgagtttgaagttgaaggaaactctgctgattttgctagtgatattggtgaattaatggagacttatctggctgaaatcgcttctgatagaaacataaacttcgcgaagttcatcggttttgctgaatgtattccgaaacagtctaggatgtatcgagccattgacatcttcctcaaggtatacatttatttgataacactaaaactatattgatgaataaactagagcttttaacattatcaaaatgttctgacctatatcttgaaaagtttaaagatcttagaaaatgttgtttaatcttgttggtgcagacacatccgaatataagtgaagtggagaagaagaaagtttgtagcttaatggactgtaaaaagctatcgcgagatgtgtatgctcacgcagctcaaaacgatcgtttccaagaaaatttaagcaattcagattctccagcaccagcaacagcagaaaaaactctttctcctcctgagctcagctcctacaagaatgaactctccaaactaaaccgggaaaaccaatacttgaagcttgagttgctcaaagtgaaaatgaagttcaaggagttggagaaggagaaagcttttgaagtcatgagtggttcggattgttcttcttcggtttcaactgcttcggtggctaagcctcgattacctagaaagtcatttataaactctgtttctcaaaaactcggaaagcttattaacccttttggcctcaaacaaggacaaaccaaacaacctaaaagcagaagacactctatatcttaaacaatacatgaacacttgttcttgttggaaattttcaatttctagtcatggatgtttctgtgttgattgtatagagagctgagaatgtctttgagtttatgtgttgagtataatcttttttttgtcgacattttgtgttgagtataatcttaagaatcgttaagtcgtcatagagcaattctcaaaaagtcaacagaaaatttaattattcggattaaaaaaaaaaaacttaatttagaagacactcgaagcatggggaagaaagatacaaagagactcttcttcttttcatcttttgtattgtggtaatcggaaaatttaaagtggaaacgtgattttagttaggatcattagggttagagttaaatgtgggattttatttttgatttagaactatcacaaccaaaccgttaggattcctacaaaaaaaaaaaccaaaccgttaggattgaggaaaaggttaaccaaatagttgaacatagattttggtttggttttgatcggtttaaattcggttttggttccgtttgcttagactttagttaccgcagatattataatggtttgacattaacaaagttgtcaacacaaacaaggagcgtgccttgcacaatctgctcataattgttattaaagaaaaagggcattgcttttctcataatttcatggcgtgtcagaatgaagatacaaattctatgtatggttttgagggatattactgaaacttttttacttattacaagtttatcaattactccatattaagcattgtgtgcggagttccattctcatttaattttgttttctatcgattcaaatgtctatcaagtataaaccaacaatcacaatctaacccataaaacagtctaaaacctccatttactaagttagaaaaaaactcctatataaaagtaacatattatgaagagaaaaaaaatgatgagtcttataacagttaatggtgaatactacaattgtctaaactaattttattgtcaatttatttttctttttataatttatttatatggttcatttacatgtactacaattattcttatatatttttcattatgatgctctcactaactttcatcagttcatgtaacaacgtgcaaaccacatctccactttcagtatttggattccactttcatgtttcgacgatccatatttgtattattgttggcaatccacatttacttttttcactagataaatccataatcacatatttatacaattaatcattttagtatacaattaattaaggttaattaaacttgctattgttatttatatttcattctcactgaagaactcttcgttgatgattttccactcttgtaagaagtacatcatgctaacaagtataaatgaaatgaacaaggtaggcctggtgcagttaaccaaaaatcgaataattttatcaaaagcctatactaaaacaaatgaatcttctttaatattgcgttatattcttcaagcccatcattatataaacctttatcgtgcaccttttaccgtcatcatttcaaaagcaattcttcttgtcttggctcaatttatatacaacactctctctctctcggttttgtccataca

SEQ ID NO: 553 - DNA, 3000 bp, Arabidopsis thaliana
ttctatttgttctcttctgtttctcagctcctgaccgcgtttacagccatcgcctctgtttcttctctcttctattggttatcaccatatgcggtatatatgaagacgcagcttggtctatctgatccctttctttcacgctgctgctccaaatcgtttacaagaatccaaggattgctacttgtggcttgtgctatgacagttgtggcatggctcatctctggccattgggtgttgaacaatttgctcggaatctccatttgtattgcgtttgttagccatgttcgtcttcctaatatcaaaatctgtgcaatgctcctcgtgtgtctctttgtatatgacatattctgggttttcttctctgagagattctttggtgctaacgttatggtggccgtggcaacccagcaagcatcaaacccagttcacacagtggctaacagtttgaatcttcctggactgcaattgatcacaaagaaactggaactacctgttaaaattgtgtttcctcggaacctattgggcggtgtggtgcccggtgtgagtgcctcagatttcatgatgcttggtcttggtgacatggtacagactaatcccttctttgattttaagattggtatgtcgttatatgtgtactaactgtaagaaatgttctctctcagactatagtgacgaggagataaaaaaaacatgttgtattgattaactgttttgttgttccaggctatccctgcaatgcttttggctttggtcctctgctttgaccatcgaaaaactagagatgtggtgaatatttttgatctaaaatcttccaagggacacaaatacatttggtatgcacttcccggatatgccattggcttggtggcggctctagctgcaggtgtcttgacccactcacctcagccagctctactttatctggtaatattctcctcatgtgacttctttgttcctcttggtctaacatcaaaagtatatattctactacgtgtatttgtgcacaaccgatatcaacacttgattcaactgaaattttgttgatagaatctttgtagtctcaatccaatgattttaagagcttgatcagtgtgaagtatagtgagattatgatgtataatctgttttcgatgtggatatataggtaccatctacgttaggaccggtgatcttcatgtcatggcggagaaaggatcttgcggagctgtgggaaggacctgcattatctaatcccattgagaaatctcatgaaatagagatctgagtttattatatcaatcaagatgattcagaaatctaaaacatattacataaaacaaagacgcttagtaggaaaacatcagatcaagaattcttgtattcttaagttcccaaaaaaagaaaaaaaaaaaaaaaattggtcagaaagagagatgatgtcttatatccctcattttttttgcgttactcaaagggaggaaaaataaacaattaacaagttctttaattttttcttatgaatagagataccaatactaaaaaacgttggcttttgtaatgaagaagttttagtgataatataagttaaaattaaaagtgtgtaaccaattagtcttttttttttccgtcaaaaaaaagaaaaaaaaaaaaaagactaattggttacacacttttaattttaacatatattatcactaaaaccaattagtcaattacacaaatttagtaataatacatagggtctctaatatatattaagctttatataaactaatgaggaaatctgtaaaaatatacaaataagaatttccaaagtagatcctatgtaatttcgaagcgtattactgtgcataagacagtgttaaccaaaaaaaaaaaaaaacatttccgagatgaactgtgttttgtcctcaccggataagaaagtggaagaatgaaccactacaaagtccgcgtcgaaagcactcagttataaaagtaaaattgacatgcgattacattaaaaataccaaactcgcttgtccatttttattgatattgcttgctaatggaagccagctacatgtccgctttcttgtttgactttctttcttttctctttgagttctcttcaatattaatagatgcattttatgttttgcttcttctgagtagcatcgtgaatcaagtcgccattatcttattcagcactaatataattatatatagccagaatttctaaatttcaagaatgtagacaagttctagaaacgccgtccacagttccataaattctagctagttttctgtaatatttcacataacgattcatagacttttctgttcagacaaatatatactttgcaaaacagaacatcaagctcagtagctcacaaccaaaattctctgtccaaatttgaagtaacggaacctagtgtcttgctgggtttgagacttctcaatcaccatatagtcagaaatacctatgaataagattatcttgatgattttttaaaaaaagattttcttcgttaagcttttcttttgtaattagttataaaccttctcactttcaatgaaattcacattcatataagtttaaattttaaattaaaatattggtcagctatagactatagtaagtatattaaataataataacattttttgtggacaaagagaattcgggttttggggttttggcaaaggaaagaaatggtcatatgtggaacactacgtgccacttttcatgcaataacatgcaaatattaggtcagccactaggaatagaataagttgaatagttttttacgatgataagagtaagcgggaagccataatagaccactatcccaaaactttaatctgcttccaactcattatgggaccaactaatacaaaatgatatgtattccatgttccaaccactccaatacgaattacgaagcaagcgtgtctcagtgtctgagtgcgactgccttctctctatatataagagatatacatagtgaattaaacatcttaattatactgatctttatc

SEQ ID NO: 554 - DNA, 3000 bp, Arabidopsis thaliana
aaattcggagattttggaatctggattttgtgagaatcgattgggttttagatgggaactgagaaattgaagatgaaaatgagatttctggtgctgaagatgaacaaatgcgaaggagagaagaagatggagatgaagaacaaagctccattgcttctttagactgttactatcaaacaaaaattaagaatcaaatcatccaattcgactcgagaacacgcaaaagacacgatttttgcagcagtagaagaaaatggtaacgaagaagattgcagagttccatggataaggtcatggcggggagatttttctaatggatcatggtttcagtgtaaatcattcaggcccgtaaaagcctattataaagcccaataatatagcaagacccgtaagacattgtagtatgaaatgatcatcattaatatagcttagacttagattatttcacattcaaaattcaaagatgctcaaatctatatgtggatctctgttacgttggatacttttctatagcatgcattcaaaatctatattattttgcttgtataaattgtattgtattgcagcatgaattatcatatgtaatacgtaatcatgacaatagactatagatataatcatataatctatgatactttatatataaatatgtcacactttgcaggaaaaagattccttttgtgttggtcttttttctttaaatcacgtggcacatgttaatccgatttgcattatttagaaaaattatagaaaacgtacaagtcatcctatattggtctttcttacaactatttgttttatttaagtacaaacattatattgtttactgtttcatggtcaagagtctctacgcgtgttatctaagtaatctaatgaattggtaaaattaaatctaaattagattatagtattttgtaaacgatttgaaagaatgagaatccaattatagaattcaaaacactattatattatatattaaacatattggaaagggttgacaaaagaaaaacataccggaaatgagatcctctctttctaagtaattattggcgttataactttcatcataaatcataagcacggcttataggtatacatgtcactgaaacttgtatcaaaacatgtaactaacaaatatcattagttattgtatatatataaacaaaaatgctatgacaggaagcaatctaaagactatactcattaacgaattaggttctacaattacactcgatcacataaatttctgttttatatttattacaaacccatgtatgtgtagagtctatagtttaatagtgtttaattaaaatttatcacaaacccatgtatgtgtagagtttaatagagaaggaaaattttagtgaatcgctaaggtaatgacaagatacaatgatacatgcattctaagtaactccatgcgaaacgatcctaatattgacttacaaacatatagcattttggctgtagtatatttaataatgttgtaggacacaacatgtagattaattgattaaagacaacgtgcatgtctcttttttttctctatgatgcgggccttttagcagaggaatgctacagacatgtaaagttttgataaaattgaataattagctaattatggcctgacttgtttaacctctatatccagaatgaacattatattgaaaactgatctttccacaactatatatgtaatatagttttttttgttttgttgcattctgatctcgtcattctgatgtaatatagatccttgccatcataaaaaaaaatggtaatcgatttttagttaagtatgaagttgtcctcttagtttaaaattacagtcagcgcaaatgaattatcttcccagaaatcaattaattttcttgcattttaaaaagccagacataaagttttgactgattaagacatacatgtatatatatggttaaatgatttatcatttttctcgatcgattggataaaggacatggttttcttagaaaagaatataagataaatgacaaataacagaaagaagcgtgattgcctttacttgcatgcagatgcagtagtctcccattttgaatgactgctctaaactcttaaagtataactattctcgtcaactaaagtttttgtttcttttttaaacgtcaactaaagtctatatcaataacaataatttatcgcctaaccagtaaccatagataaagaaaactttaaatctagaaaccattagcttctgaaacaaagtaaaacagcccttaataaagccatgaccatgtcaactgtttcggaccatgtgtagtgtacgtagtaaacatttaaattgataatgaaatagcaagacgcaaatggacgtttgtaaaaattgtatggttggtaaaaaagacatgaggctatatatgaatttctgtcattaaatcagctttaggtattacttgttaggattaaggttatcgtagttgattagactaattaactaatatatgaaccaaaaaagtataatagtcaggagtagtagttgagatttcaaaaagattcaaggtggccataacacaaatattattcgcaatgacaagtgaagcatcgttttcacttttcaacttatccctctcaatccccaccaccaccactctctattccctcatatagatagatcatcctagtgatcatatacacacacaaacattgatagagaacaaaacgaaattggaaaaattcattttaaattttaaaaatacaaaaataatggaattggaaaaagtcttttttttgtaaatactaatcaaatattttaaaattaacaaaaaattcaatagtaaaaaaaagccatcaaaaaatgatgtcaacaattagataagtatttagtctttttctcttttaaaaaatgatatgcaagctggccggcgctacttgtgcgcacacataaaagcatatatataagatccctcactcgattcatgtaattatacacatatagagagattgagtgaaaatatttttttttaa

SEQ ID NO: 555 - DNA, 3000 bp, Arabidopsis thaliana
gccgtaacttctacgccggaagttgtcctaacgtcgaacaaatcgttagaaacgccgtacagaaaaaagtccaacaaactttcaccaccattcccgccactctacgcctctatttccatgattgtttcgtcaatgtaaaacatattttttattgatattattttcttgcgtaaaattatccattatttggtctaaataattgattaatattcataggggtgtgatgcatcagtgatgatagcgtcaacaaataataataaggcggagaaggatcatgaggaaaatttatcgttggccggagatggattcgacaccgtcattaaagctaaagaagctctcgatgccgtcccaaattgtcgtaacaaagtttcatgcgctgatattctcacgatggccactcgtgacgtcgttaatcttgttagtaactcaagcttatttattctattaaattaaaacattagtataagttattacattaaattcaatataggcgggtggaccacaatacgacgtggaattgggaaggctagatggactatcatcaacagcggctagcgtcggagggaagttgccgcatccgaccgacgatgtcaataaactcacttcactcttcgccaaaaacggccttagccttaacgacatgatcgctctctccggtaagatttgaactacttctcgatcataaatagtatcattcgaaccaaactaatagctatgtgatttaatattccggtttagctaactggatatcggacccgaatttgattagtatttaagttggtttatatatacccgaatttgattagtatttaagttggtttatatttccggtcctaatttagatttcgtttgatcttaaacatctcaggggcacacacattaggattcgcgcattgcacaaaagtgttcaatcggatatacactttcaacaagacaactaaagtggatcccacggttaacaaagattacgtgacagagctaaaagcgtcgtgtcctcgaaacatagatccaagagtggctattaacatggacccaacaacaccaagacaattcgacaacgtttactacaaaaacttgcaacaagggaaaggattgttcacgtcggatcaagtcttattcacggatcgtcggtcaaagccaaccgttgacttatgggctaataatggacagttgtttaatcaagcttttattaactcgatgatcaagcttggtcgtgttggtgttaaaactggtagtaatggtaatatccgtcgtgattgtggagcttttaattgatttaaatatatctgtattagattttgtttattgtatttgggtataggatgggtcatgggtctcataaagctggttcagctaaattgaaaattgtaataaatctctgtcttgggtttcagtttgcaaaacctaaactgtaattatagagtggaggaaataagaagtatcgtataatatttatcaagggataaatacaggccatccattatgggccgcgtaagagccaatgccaaattttaagaattttcttaaacaaattattatgaaaaaggaccaagaatgctggatgctcctacatacatataaagttttgataaaattaaaataattaacgtctatatccagaataaagtcaatgagcattatatatccaaaactgatctttccacaactatacaatatggatgtgttttttttttcttttggttgcattctgatatgttccttcctcttgtctgcagcgattacttgttattttgggttattcgtggaaatacaattcaaccatttgttttgaacgtgtaagataagtaatatatggttaaattatttaccatttttctcaatcgattagacaaaggacctggtgttattagaatataatataaatgacaaacaacagaaagaagcgtgattgcccttacttagatttttttggacaaacccatacttagattagatgcaagagtagccctttttgaatgactgtaatcttgtcaactaaagtttttgtttctttttaaaacgtcaactaaagtccatatcaatagctaatcgcctaatcatagataaaaactttaaaatctatattaaaccattagcttctgaaataaagtaaaacagccctaaataaaaccatgaccatgtcaactaattcggacgaccatgtgtccatgtgtagcttttcttttctagaactacgagatccaaaattaagcagtgtttcataacgaaataactaccgaatgtaatgaatttgatggatagatgatcatgttattttcttaagataaaggtgtccagaagaaattaataaatatcttaattgttcaaaaagtgttacatttttgccatcaaaatagaaaaatgatgatgaaatagcgctagacgcaaatcggaattttgtaaaaaaatggtatggtaagtaacaagaatatgagagagagagactatatgaagtccttctatcatctttagttgttacttgttaagattgaggttaccgtagttgattagactaattaatattagttgatccaaaaaagtatgatattcaggagtagtgtagagatttcggaaagattcaaggtgaccattacacaatacttaaatactattcgcaatgacaagtgaagcatcgttatcaacttctccctctcaatccccaccaccactctctattacctcatatagatagatcatcctagtgatcatacacacaacattgatagcgaacaccaatagtatgctatattcacaacaaaacaaaaatggactaattcatttgtttttttgaagtaaaggaattgaacaataattattttattttttttgggaaatactattcaagtatttgaaattagaaaagtatttagtctttttctctttaaaatatgaatgcaagctggccgctggccggcacacacagcacaaagcatgtatataagatctctcactccatttatgtaattatacatataaagagaaattgttttttttttttaa

SEQ ID NO: 556 - DNA, 3000 bp, Arabidopsis thaliana
gtcactagctaacagtaagagctctgcctcaaaacgcacttaatatttggacaaagagataaagagtatataaagcataccatgtcataaccccgagaaactttagcttgaaagaaagagtcgtgtgcttcggatatgtgaatacttagtaagcgagaagtagggtagacccttgagcacactgaacaagaggcagtgtgccgtgcattatagtgatcttcaaaatggtccaaagatttcaggcgttcaggacagccaacaatgggacacgagattcttctgctcaaaatagtcaaactcatgaccatcaaatttcgtagataattgtggaccaaatttggaattgaaactagtctacataaatttgatcagtgacacaatgccatattactgattgccacttaaaaatgtggatattgaaagaaaactacatagataacagtgatcaaattcatagccatttggttactattagctagaattcttacacgcactaccaacacatatgtgaactgcacagtaaacaatcagaaataggataaatggcattgacaccaaaccagattcaccaagacaaaaaaacaaaaataacagtacagattcttagcttcagtataccaatcaagagaataacacatcaaaaaccaatgtaaaacacatgaaactcttgtaagcaataatctaatctaaaaattataatcattgccatagttgactgaattgttttcatttactatcagaaaacagtccgcaacaaaaaaaaaatctcatccgtgaagaaggagaaatacctggtttcaatttccacaaatttatgcagatggttgatttcatcttctgtgaagtccaatgtcacctgtaaattaaaatcctcctttatgactcaactcttgcgagcataaatatttgtagatgataaacaatctacagcataatacttataaaacgattactaagcatcatataactacatggagaaggagaatgaaacaatcgtttaatccaaattgacaaagcagacctaattacaagacttcttcaaaatgaaaaattcgctgttacagaataaccaaacagatcgaaagcaaccgaacagttatcatcactaagaaaatgaattccccaaaaatcgtttctggatactaccacaaagaaataattcgacctcaaaatctcagaaccgcttcgatttgagctatgctaacacgaatatcatcatcaagtattcaagtggaccattaacgagagtgtctagacaagaaaccgattttactgaaaattgatcatgtagattgtttattccctaagaaaagcattacgtcagattcgatcgattcagattccataaggagtacctgtttagcaagtagctcgcgctcgacatttccagatgcaaagaacggcgaatccggaggaaatcttcgtcggattgggttccagtacggaaagcctaactcgcctaccgtatctaccgccatacccgtagccatcgcttccggcactgagcagagcagaagaaattcaaaattttccgtttacgtctcacaaacatgaaacaagtatccaactgaacatttcctccgctccggtttattaactggatccttcctggactatatgatatcttgttcggcccaaagaaggcccacgtataagaaacaccattttctttttcttttatatctagaaattcaagcccaaaaatcttatattttccaaaaacgggattcacaccagattaaatttatcttctttggagaaaaaatcctttccaacatgtttcgaacctagcaccttcacttgagagatttaccactacctcattggttaacaccactatatttttaaactcgagtttcttaacaaaactcattatgtttctatcagttgattaagaaatgaagagagaaaaaattctgaatttttattttttattaattaaatcagatagctagaatgttgatcatgtaatatggattcaaacattttctaaatcaatccagattgaacttttttctttaatcaactttatggtggtgtatatagttaattaaaaacattttctatatttctatataccaaagtaatttggttaagctctaatgtgtttgtcacttcgtagtttgtacacgtgctgatataattatatattggtcacctgcaatgagcttataaatagttttctaatttgtggttgaaattgaaatgatctagaaatcttctcactaacattatatgattcttttgtagaaaataacactttagtcatcagcaatttgaatatttgctaagtttctattatcatcaaaaggggaactagtcctgtgatatgataaatttatactattataatttataccaaaagatatctgtatcagaaaataaccaaaattgggtaatattaaatgttaaatttgaatttcggctacaatagaggaaccgttgagctaaagttgatgaactaaattagaacaggtattccgctgaattcatggcgatcagtcaaaatcattatcatattaggatggacaaagactaattttcaaactcatcttttgaatttaatttatccattttgtgtttaacgacactatattatacgtttcatcaagacaaagtattttaaaatatcagaaaaaaattccatgcagatgactgacttaatgaggtttgttaaactgtcactgtcagttaaaccccctaactcaagaaatgtgtactcgcttaagtaaaatttgagaaatccttgttgtaaaattctggcattcacctgtgaatgtgattagattttaatcatcaaataacttattcattaacaaaaaattaaaatataagcacatttatactatagagactagatccagtggctatagataaatgaggtggcatatcggagggtcaaaacagattggtgtggtcctatttattcaagaaaggactgtatcgacagaagaagggtttaaagaagacaaagaaattaaaggagaaaaatcgatcacg

SEQ ID NO: 557 - DNA, 3000 bp, Arabidopsis thaliana
ttgtgaagggctttggtgaccactctcatcagacggttctaaagggaatgcatgagcttgctcgaccactgagtcttgcctttctcttaaagttttttcgattagtgtcttgagaaagttcatcacttgaaccgcatacatcagtgctgtcagtggatcatccatctacaatacaagtgtttctcaatcattttatcccatctgaccccgagttaaacattgataatcaaccttgttgttgcagactcacctgtgtcatatttggtgcgaaaaccatagcgatgttgcgtgaattcatcttgtttagatgttcatactgaacaacatctgccattagattgatggcccaatcaagtagagcagcttctgtaggtggaagaagcctaacgagctcaacattttcctcttctgtttggcactgcatcacctgttcaggcgacaacgaatcaagaacgcttgtcggcagttctctaaaccatgcctgaaaccgaaaaccagaattaaaaaccaaggttcatatataagttttggaaataagatgtgcatatgttacataccttgataagccctgccaaacagtgaacatcgattcgctcaggtataaatcctcggtttaattgttccctaaccgcctcttcctcactattctcagcagtgagtctaaaaatgccctctgcctaaaaaaataaatgaagaaatgattacatggaaagcttataatatattcactttggagtaaactcgatgaagcaatgtacattacctgcaagcctccttgactatataaacagttttgcatcagcaatagtatggttggtacacaattgcctcttgaatcatacgataattgcattgattcggttgataccccaaagactgttgcactaaagtaatgagataccaaaagaggtaagagatgggatagcacacgagagacaatttatacttccaaaacaaatattccgagaagagcaaagttacaattgcataggcgcagtttcacccttttcaacattgatcttatcgattaagcatgtaaatagttggatgaacaatgcaaccttcacagaatctaacaactaagagatagtatctaagacatcaaatatagatgtttgaagacaagtaactatagtataactgcaagaatgaacacattggttcatggctcaatagcccaatcttgtaaatatgaagtgtttagcttccacggaaacacatagctatgagactgaaaaaacagagagagacaagaacgtgctctaatcacttcatgtactgactgataaaggaatcaaaaatcaaataagttcttctcgttttggtttcactaattccacataaaccttaatctgtatacaaccaaaacttagaggttctacaactcgaaacaaggaagccttaatcagaagcattctatatccatctgctcacccaccccaaaattgcaggacaagatcattgttgtgaggagacttttaagagcaattcaataaaaaggtaggatctttggacaatgtacctggcgcttggagctcttctaggaacttcaggctcgaattcaacaggcaaacccaagaagccattgaaacgatcaaaggtaacgtgcgccacgtgtctgacattggtaggccatccaatctccatgctacaaagctccctccggttactcttgcaagaaatcaaagatctcctgaaaatggcaacaagaagagccaacaacgaaatctgatcttccccaccatcgtcttcttctcctccatcggtactgctccgtcttctcaaatcttgttcttcgattgaggcatgaaagtcaacatcttgatcgaatctagcaactgggtttctccggttgtggtcagagctaatcaagagagtcgcattagagcgagaggcgtaagataaagaagaaggtgaaggagaagaagaagaagaagaagatgaatgagaagcgcttggagatgaaggaaagtgaagaacttcagtcatggcgcttcagattttggcaaaggaaacaacttttttggttcaaatcatttgtcaatgaaagaaaaggttttgaattgaaggaaatgtataaacccggaaatagagctcaagatcgaagattagattgttgattcaaaaccctaattagatgaattcggttgccactaatgaacaaaaaaacagagttttgttactactaattaaatttaaataaatgactaaacattgaccataaaaagtggttaaaccatataaaaatagttgaataagataagttttggtaacacaaaaaaaaaagagaatactactgattgttacatatttatgattgattttagttaaactattggaggttttacaattaaattagttaacattaagtattgatataaaaggataaacattgatatattaatgtttacaagtccttatcacttataaatgtggatttcgtttgggggaaaatcagtatactttatgatttttgcacgttttctaaaatgtgaaaccatgttatgttcttagattagtagtatccacgttttcacaaaatataccattcaaacgcttgctctatagtacataatccctatgttgagccagtagttaagaagcattttgctgaatttactaaaacaaagatcaaggattttattgcgttttaaagataaactcgtgttatgcatacaagtgatttgcttacaaaaaattatgtgatatatactcttcctatgggagaaaaaaaaaagaattgaagaaaacattagaaaaacgtatcttattatttgcattcggattgccaattttattataaaatagaaccagcccgacattagaaaatcataatgtgatcgcatgagtgagctagaatcaaatactatatccatgaacgcacgttagagaatcgtgcttgccacacatttggtaacaaacttgaacactataaaagttgttaacaatttttctacagttccccacatactagaattcatatagaaatttcaactaaaa

SEQ ID NO: 558 - DNA, 3000 bp, Arabidopsis thaliana
tatacagcaaatttttaagctagacataataatatacagcgcaaaatctatgaagctcgttgacacttgacgaaactttacatctcaaaactaattaactaattatcttagaatagtaatacatttattttatatactaaattacgttctaaaatttttcaatgcagagtttagagtagtaatacatttaaattatatattaaatttttcaatgttcttttctttagcgattgaataattgtgtatagtcaatttggataattttacattatgaagttgtcatatgactcatatacagtatatgatatcactatattcgttatatacacgtgccataaagttagacttccattcaatctttataactgagttgtatccagacctttgtcaaaaattaatccaaaagttaaaaaaaaaaatctatatgaattagtaacctaactaaacagggaatatgatattagtttgaaataaaagcatttatgtttcaaaacaacaaaaccattctttctcccaacataataataatatatttgaaatgttcatcgataattaaaaaatcatcaatcatacttgtaaagtcagattacaaattcagtgtattatcgtttactaagttaatgtcaatgctcggttgattgaacatataaaaaatgttttttgattattggaccacttacaaaatttagttctttgaacggaaataattataatgacacacaaactattgtcagattcttttcgaatctcttataaaatcatacattgctgattaatgttttaacatacagttacattaacataaaccattagtatatccacaagtttgggatatgactcatatgatatgttagcgttcgcgatcagcattcagcaagcgattaagtctgtttagatgtttgaatttatgatatatagacaaaattatcattgcaatttgtctaaatgtacaaaagtatatattatcgtaaatataaatcgtggtactatactctttatctaacgctttggttgtgtatagtgtgcacacctgttacgtatatctgtcatgttgaaatggtaaaccacccaaagtttagataactaaaagagtgattttctaattggaatccgaaacaaatattatttaatcaaaacattacgagacggcaaaaaatacaaaaaaaataacatagtggttttggagttccggacacgtgggaggaactaagataccggtgacacgtgtatgtgtaacgtttcggccatacaaaacgttcattagattctttaaacatcatctttcatatacacttggtcatataaatcgctttcatcggagagtcaaccaatataagttgatgatacatctttagccgatttttttttttctttttttaatgttaaaacatgatcacaattaggtttggataggataataacaacagcaactgaatttggtaatgataccgatgttaatatttatgtacgttaaacgataaatttgaataagaaaaaaaaaaagcacaaaaatcatacaatttgattaaacagacagtttatataatgtgtactgttggtaatcctaccgctagacaatgtacttttaatgtgattactaattacaaaagtggtaagaattagtattgcgctacttctatgtcaaactaatcataccaaatagatcttatcgataaaacatagatatattatatatatatgtggattgtggtgatcatagatgcatagacttttgccccaatcatatgttagttaatcatgcctgacgtagttttatacaataattcttttgtatatcagctggggccacgtaagaaccccattcttacctcaccttgatgctatgcttttactatactatcagataatcacataaattagattagaggtgtgattggtgtttattactagagcaatcagtactattcagtagaaattaagaaaagaaaaaagtttttttttttaaagatagagaggaggagaaaagaaaaggtaaatttagagaaattttgtttcttcgtgtaatggcaaaaactacagtgaacgcaacaaaatttgcaaagaaagatgaggctatgaggctatgactatccccattgaaacagagcaaaaccccaagaacatcactgagtattttcaatgactatcgataaagtttcacattgttgttttcatacattattatatgcaacagaaacagttttcagtttgatttttcacttttgtccttttgtctgcctctctgagagataagtagacagagaaagatgtttagttttttggattatttactttgcaaggattattacggagaaggaaacacgtaacgaaatgaaaatgcatagacatgcaaattgcttagtgcttactccaccgttcattgctttattttttgttgttggaaatttggaatggaccattcctatattaatgggcctgatctgtttagagaataatgggtttcattaggcccataattttattcgaattcatcaatcttcttgatctctctattcattcttctgtattcaataatttttaagtttttctccggtcttctctgtctctctgtccattttcgtggcgaagaaggtgaatttcttctctttgtttctcctagatttctcaaaaagattgtaccttttggattctagatcttatttgatccaatgttggatcgaaattatccttctttgttctagaatttggttactgggctgaacagatcttgtttgactcatggaacaaattgtggatttttgatttgatctgattgaaatttactgactttactatgaaacaaaggggatcgtatcttatgcctgacccgatcaccgttttagattcatgtgtttgtttaaacaatgttgttgaagttgtcattttttggattctgtggtttggtttctcacgttgtttatgcaaattcatagataaaaattatatgaagatttgtgttgtttttgacaaacagattttttaaggtcttttcaagaaatt

SEQ ID NO: 559 - DNA, 3000 bp, Arabidopsis thaliana
gtgttccaatggatccatacgctcgccgtgtaatcgagcctgttcaattccggaacccgtttctatggaccgcagtgattcgtgggtatgcgatagaaggtaaatttgatgaagctattgctatgtatggatgtatgaggaaagaagagattacgcctgtttctttcactttctctgctcttttgaaagcttgtggaacaatgaaagatttgaatttgggtcgtcagtttcatgcacagacgtttagacttagagggttttgttttgtatacgttgggaatacaatgattgatatgtatgtgaaatgtgaatctattgattgtgcgcgtaaggtgtttgatgaaatgcctgaacgagatgtgatatcgtggactgagcttattgctgcgtatgcgagagttggaaatatggaatgtgcagcggaactgtttgaaagtttgcctacgaaggatatggtggcttggactgctatggttacgggatttgcgcagaatgctaaacctcaggaagctttagagtattttgataggatggagaaatcgggaattcgagctgatgaggttactgtcgccggatatatatcggcttgtgcgcagcttggagcaagtaaatacgctgatcgggctgttcaaattgctcagaaatctgggtattctcctagtgatcacgttgttatcgggtctgctttgatagatatgtactcgaaatgtggaaacgtagaagaggcagttaatgtgtttatgtcgatgaacaacaaaaacgttttcacttatagttcgatgatcctaggtcttgctacgcacgggcgtgctcaagaggctttacatctttttcattacatggtaacacagacagagataaaaccaaatacggttacatttgttggtgcgcttatggcttgcagccactcgggacttgttgaccaaggacgtcaagtatttgattctatgtatcaaacatttggtgttcaaccaacgcgggatcactatacttgtatggtcgatcttcttggccgtacagggcggttacaagaagcccttgagctgattaaaactatgtctgttgagccacacggaggtgtatggggtgcattgctcggtgcctgcaggattcacaacaatccagagatagcagagattgctgcagaacatttgtttgaattggaaccggacattatcggaaactatatattgctctccaatgtctacgcgtcagctggagactggggcggagttttaagagtgcggaaactgattaaagaaaagggtttgaagaagacacccgcggttagttgggttgtagataagaatggtcagatgcataagtttttccctggaaacctgaaccatccaatgtcaaataagattcaagacaagttagaagagcttgtagaaagattaacggtattaggatatcaaccggatttgagctctgtgccatacgacgtgagtgacaatgcgaagaggttgatactgatacagcataccgagaagctagctttagcgttctctttactcactacgaacagagattctacgataacaataatgaagaatttgaggatgtgcctagattgtcacaagtttatgcgtttggcatcagaggtcacagggaaggtaattataatgagggataatatgagattccaccattttaggagtggagattgttcttgtggtgatttttggtgagaatcgaggttgtacacagaccaaatgcaatcttcgaggagacttttcttgtgaatcaagaaaatggctatggagaattgagaaactgggatagttttggtcgaagaattttgaacacatctcgtgaagacttgagagttttaacagaaacgccacggatctgaatcagatcatagctagtgtatttttatgcgacttcgatcttgcttggtcctcatgggcttgggctgtctctataggcccaattatatacgtccttttgtgttagagctaattcgttcttttttgtgttacagctaattcgttcgttttttacgcatagcatatacctaccaaaacgaacgcatgtcttcgctgtagcctgtaattcattttttcactttaacaacttcgaatatgatcaataatacaaacactttcgtgttaatttttttcttcttaaataaacttttctattagtctctttgtattgctatcataagagtataatgtttggtatatattaagactttttggaaatatgatggtccacacaaagaggtatattcgactattcgtagatttgcgagaggatcaaacttttcgtcgtaaaatgtttaccaccgttttatttgtctgaaactgaaaacaacgaacagtgtctatttaattaaccaaaacggcagacacaaatctctgggtggagccgatttctacggaagtcaacaaaacgcaccgtcgctgcagatcactacctcctctttcttccttaacgaaaacgaaaacattgaacagagagcaagaacaaaaaggcacgaaagcaaaagaattctcaaactcctgagaaaaattcgagctccgtgtgattaattaggtaacgtattgctcgatcttcagatgaatttggagttttgctttcttcaagcttattctattttgcgagattttcggagaaatgataaattaattgatgtttttgagtttcttcctgatctcgatgtgttcgaatgtaattagatttgagttgcgatattgagagatctctgttgtttgaattttgaatttggatcttcctgatgtggttttgcttcttcaacgatggggtttatcgttgctttcccaatattttactgagttcttaagcttactcgtaaagtgattatctgctaggtgttcttctgcaattgcttttgattcaatgtcctctttgatgtgaagtaatgcttaatcaattcatattttgcagtttgtgttggtaaacttcaatcagatgagtttgatgatgaaagtttagaagagtgtttttgcttccaaagcaaaataaaaacaa

SEQ ID NO: 560 - DNA, 3000 bp, Arabidopsis thaliana
taaccccttaaaaggttcttattttagtggcaaaaatatattttctgcaaaccgggagtttggggaaatcatataaagtcatacctgaatgcgtttaagacaggttcaagctaatcccaggaggaataatccggtaatgggagagtgagctgggaagaacgagattttgcttcacagaggaatatcatcgaacgactggacggcaagatgtgaagaactcaaatgaatagacgatgacttgaggtttagtaaatcggatcaaagtgagtaatacgaaacacccatgagctttgatcgaatacgtttgttcacagatttgatatgtagcagaatggtgtgattaggaaagaaggaatcttgcgttttgattctatcagcctctgttgggctttgaggttttaaaacctaaccggatatattcaaagggtttacgtttaaccggaatttggtcggttcagccacaaaaatttcagatttggacctaggaatagttaacaaattttaatcctataaaattcaggagacgtgtgaaaaaaatgtcaaatgtaaatatgtaacatgcaccaattagtaattacagaactctgtttttggtctaacaccattgatttgtccattacattatgcatacaaaaagaaaaacctaggtctacatagttcagagtgaaaaaaaaactttgatctaatcttcaaatttcatagccaattccaaattatagcgtatacttaattatgtgattttactttcgcaagatggccgtaaaatatgactgaattaccgcacaaggttttactcccgaagatacaccacgaattgcaagaaacaattaaaaattatagttacttagatataaacattataattactttttttttttttttttccgtcaaacattatagttacttagagtgggagatagtgttgtttgaaaccattattaatcactgcataacattgttgcctttgatcgtgctttagattttcccaaccaccttgcacattccttgatgcatatccaccgttgacaatctcccgattcacaccaacaccattgttgttaacactaaaccctcctgatccactcgaattcgtcatcgctaatccgttcttgttgttactattattgttaaatacgcgttgattattatcccaaccaatgagaggctggttatgaaccaagcttttgtataacttgagctcttcacaaatcctcctatactctccataggagccaaggaccggatctttctgtctccatagagcttcccatgttaaagaatcagagagcttggtacggtcctcttcacgtaccgtccgtaccattttttgtacgttactgacaccgaagaccttgtgcacggcctgaaactctttagtcttgcgggctgggaaatacggcgataagatacattcgttgttgcatttcttcctttgatgtttgcatgaagcacaagcttgatgcgacgatgagttattggagatgttactggtgatgctggtgttgttagagttcctttgcatcatgtcatgtccctagtaacggaaacttgaaattttaatacaaatataaatgttagggatcgataaggtttgaagcatcgatatatataaaatttccacacaccgtatgtatattcacaattgacaaggaaataagaaggaaacagatatataactcagagaagaacaaagttttgaacataatgtcaagaagggtcatatacaaacctcttgcctcttttattttccttcatttgtgggttaatagcaattggagatatggatttatattaataataagggatattggtagatgattattatttattatatgttatttttggaaaaaaataaagaagaatattaatggtgcacaaagagtttgtctaatgaacatgaaaagattgtttggtttgatgaaagaaaaaggtgtttggatgaagggtcgataatgatttatgagttttaggttgcccatgaaaaaggacaataacaactaggaaatcaataaacaaaacgaaattttgctttacatatttgatttttgttttttataattataatgggaaaatatgattccaagcattttggatgaaaatgtgtggaatgtaaagaataatactagtagtatgttagatattaatataatttgttggtggcttccatatttaagagtttttatgtaggcataacatggaaagaatgattacaattgcctcttcttcttcttatttttcctcttcttgcatcttagttatgtattacagtgagtaaccgagtataaaaggggaacgaagtatataatgtgtaggaagatgttttgtggagagatcttgttcatagaatttggcatatacaactagattctcgtgatatctttctattattatgtaatgcatttcccgtgttcaatacgtgatagtgatatgcaagatccatgcatggtaatatttacgtaatttttttatatataaaaagtatgacgacatataccgatgaatataaaaaatcttaaaattttaacatgtaccaacttaattaagcaatcgatgtctcggaaacttataagaaaatattgtgtggacactaggtttacaacagttgatacaatagtgcaccggtctgagagatgatcaaaaatcaaaatcacttttaatttcttggttcttttgtagttgaccggtcggttagaaattttttaaaccaaaagaaggttgacggatagatgaataataaacggctgagattgaacggcgataaggataacgaccttatcccaactaaaatcccttcgtacttccctaggagaggagtttcatggtctcgttaccaaattggttttaattagttttctcaaagggtatttatgtaatctcaccaccgttactaattttataaaattaaggaaactatcgttgaaacttcttcatcttccttaaaacaaccacaacgtcactttcttcccggataattgaaatcggtgatcggaatccctagaa

SEQ ID NO: 561 - DNA, 3000 bp, Arabidopsis thaliana
gaatattttacaaatcttgttttgtaagtgtacttaaaacttgtattttgctgtgctttagggaagctgttaaaaggagaaaagcttcctaaagaagaagaaaatttccagaaagtgtacgtcaaggctccatcatttctttcaattcacatgggtgttaaagcagaggttctccctccagatacagattgccatcattttgtgctcgaggtttgatagtttcctactaagatctattcacttgccaggtttatagttattgaatagcgactttcgttttgctgcatccgtaggacgattggaagaatctggaggagccttatggcagtattttcctcagcattccaaccattcttgattcatctttggctccagatggtcgacatatacttcacatatttacaacttcgtccattgaggattgggaggtaaggctactaatattattgctattttccttagctgtagaattatcctattgagtttttattgatttgctcatctttgtttatcaattcgtctatattttggtactagggactccctccaaaagagtatgaggcgaaaaaggaagatgtggcagctagaataatccagagactagagaaaaaattgtttccagggctcagttcatctattacgttcaaggaggttaggcttgttctttattcccctactattttacatgcacattgtagaaatggtgatagtaggtctgcatgatatgagaaatctgtatctgaaacccatgagaataagcctatgccttatttgggtatttagcctgtatatctaaacgttttttgaggcaggtgggaacaccaagaacacacagacgatttcttgcgagggataagggaacttatgggccaatgcctagaggaaccccgaaaggtttattaggcatgccattcaatacaacggtaagctaaagaaagagatagatagatagataacatcaggtttagttagttctggtggtgaatggttttgctaatgaaagaatggttggactaataataggctatagatggtctatactgcgtgggggatagttgttttcctggccagggagttatagctgtggctttttcaggagtgatgtgtgctcatcgggtagctgctgatattggtgagaaaatgccatatttttgcaatatgttaaatagaatgggttgattattatgagcataagaagcaatcacttttgtgttttgatttttagggcttgagaagaaatcacgagtacttgatgttggccttcttggtttacttggttggctaaggacactcgcatagatccaatacattatttccttttcttctttattatgttaatttctattgttttactatttcttcatagaattttacttttctttattttcttatttcctcgtttacttttttctagttctatataaagaagaccttcttgtaagaaatacatctcataataattttcttaagaagcatagagtttttctctcttctactggattatagagtttctggtggattccagaattttatttttcaaattcatagcttgtagacttgtaaaccgatataggtttggcgcttgcattttttagggtttttcgaccgcgtcagatttgtgcatgggaaaggttgattcataaaaactgtaagcccattaaagtaaagcccattgttaactctaaattatcttcattcagagttatatcttcattcattcaggaatttcgaaaccctagtcaattatcgagatcgatccaaccaatttttttttaaggttaaaagtttttgattcgtgaatgatgatggagcctccgcctacgaaggagattgctttggcccctgtatatgtgtattgggacatgaagaggtgtccggtccagatgactatgatgctcgtcgggttggtccgtgtatgaaacggattttaaggaaattaggctacaatggtcctgtcaccatcactgctgttggctcactagcaaaggtccctcgtgacatccttgaagcggtttcttccactggaatctctctttatcacgagttctacagtaagcatttctcatccttattccctttttattccctttattagataaagagagtctctctaagtatatagtttctgaaacaggtcgtaaaagcatggtttcgtgtttccttggccatggtatattgaatccacgtccatctactatgatggtcatatcccgtccaccagtgtacattcctccacgcttctattctaatattagccgccgacgtgaaaatagatacaactccattttcccgtttccacttgagtctcctcgagaagcctcctccaccctctggaaaaagtttcttttagctgatccagggccacttgatgaggaggatagctgcagtgaaacgcctggacttgcctcctggctttgctctgtgtgccgtcgtattggttgtggtccaggtattgctggtcaaggcgttgataattttatcacgcatatctctactcgagaacatgaactcaatgtaagctaagcatccttgccactagtttaactatattccctttctcagttgttcttttctttgcctacatttgaccctgtgttgtctttttcctcgcagcgtcgaggctgtattaccccaaaaggtgatcgcaataactccagattgaaagagagagatatgtgtaaagaagaacataagaaaatgatataatgagaacaattctttttaatccgtaatgtgtgtgactgccaaatattctcaaatgatccaccattttcatgattttttggctgttagaaataaaacgtttagaatttgtaccaaaatacggggatggatttaaacaatcaattgtacgttaagttcaacacatttgaaaatgatttatacgcatgcatcatgagcattattgtattattgtttattttatataggtccctttatatattataaaagagtgcaataaatttggttacgactttgaaactcatcgagctttcaaca

SEQ ID NO: 562 - DNA, 3000 bp, Arabidopsis thaliana
cactatccacattaagatttcaataaaatgtctcaaaatttattagtatgaatttctaatatgatatttattgttttataaatttattaattaacctagaaaaataattaaagaagtttttcttattaattggagagttacgtttttattcaatttatatcttttaggaacaaatagatagcgaaggattaaattttgcataataaatcatgaaatctcaaggtttaattaagtcaagagtatgggaaatgcgaattcaatcgcttggatgtagtaaacaagtggtaactaatatagaccacaaacattattagctttgactataaaattgatcctcaaggtgaaaagtaggctaactcctataaatctccaaggcaacatccttaattttgagagtcattcataagaagaattgtgttcataactttttttacttgatcagaaaataaactatgcaataagtaataactaggttttcaaaaggcataatcatctgtacttctttgtatatgaaaaataaatatgcaaatgcaactaaaggttttgaatcatcttttttgtttaattaagactttttaatgtaaaccaaattaaacacgatatatattcaaaatgaaaacagaattatcaacgctgctgtttctcctgacttaattcttgactcgtctccaagcaaattaaagcgtccaaatgagagatttaataataatcaaagataagtaatatcatcaatgacgaaatagtcaacataaaataaagtttattgtgatctagtcgatgtctactgtactttctcaatggttatactattattggtcccaggctcctcttgtagcgtatgcgaggactaataggctgctctcatggctcattttagaattgtaagtacgtttcgcttaagtctccttctccatatggctcttcggaagtactagtagatcacatgctctacaaagttttataccgtctccttcaagacgtatgctaagcatgcttgtgcgagtgtgcatctcccacacgtctctcgatcgtggtagttatctatgtccctagtatatgtgttgtcaaacttttattgatctacgcttgccatcatctcatgcatgcatgtgtctcacatttattatgatcgtcaaatttaaccacgaatatggagcaaacaagagacggatatggtccttgtaaagattggcaatcatagtcaattccatgaacctggtcctcaatagcttatcatatcttcttgttagcctcttatacgctaccaaaatgatagctgaaggcaaaattgatctctccaaactggtaattatatattgtgatgttcttgttgggaagtgtatctacctactctcctaaacatttggattggctatattgtttcgatttgaaaaaaataacacgttgcttttgtataataacattatttgtatagattacttggtacgtaaaattttgaagaagttaatttaaattatgttttcggtggaataaatatataaatccgaaggctgactttacacgttcgacaaagttttatggttaaactaaaaaaatgagaaaaagctagagttaggtttagtttaaatgtagttttcgttagtcttaataaatacaagtaagatagagattgatgcacatgtaccttgttgtctctgcccacttattattacacagcgtcggtgccagtattgacaacaagcttgctcacacattcggatatgtgtctttttctctccaattacaaatttgattggttcgatttttcaaaaaaaaatttccaagtccaaaggaaatttccacggaagcgcaaatcaagttttgcgtgctaaatgaaattcaaagaaaatttgtagtccatatgaataaaaattgaataaatttgcctaattaggttaaccaatcttgtaacaagaaaagggcaaaatgggaaatatagaaaatgaaataaaaatgtgtcgttgttgttttgaaactatggagaagaagaggagaggcaattatataaaaaccgactctcatatccacatatatctctctctcacccaccttatagaattttctcgccctatttttctctcaacaccaaaaatttgtattttttttttactattgtttaccccaaaaagtattgagaatcgcaaaaaaactgaattgtaaaaaatatttgagaaagagaaatacaaaaaaaaacaaaaaaaaagttttaaagaaaaggcgaaggagagatcgtgagagacagagaggctgccgaagaaaggagaatttagggtttggagacttttgttgaaatttggcgttacgttttttttgtatttcctcaacaaatttctcatctgctctcttcatattggtaagatctctctctctttcatttttttgttttttttgggttcttcttctctttgtgtaatttctgaatctcttcgtcgctggttcggattcttcatctgattgatgtttgattgaagaatgatgtttgaattacattttttctaatacaagtttttgtttttcttttgcgtttctacgatctggttttaccggctttagctttttctcgcttctgttctttgttgttttgtatttcagatctggtgttttttttcttacctgcatcaaattggtttctaccaaaacttcggaaacctcttttggcaaatgttgaatctttgaatacaatgacgatttacataatagtctcagtggccgaactggattatcttacaatttacgcaataacaaaaagttttttttttttttttttttttgtgtgtgtgtgtggtgtgttgaagatttttagtgtttgtttacttcgtttatggaagtccttttcctcttctgccatttttgtagttaactacaaattatacctactttaggaagatcctcctgctagtagctaaaagatgtagcatttattttattatcactcacttgagctaacttttttcgatctttatttggtggcagtgtctttgaacgcttcatctcctcgtc

SEQ ID NO: 563 - DNA, 3000 bp, Arabidopsis thaliana
ccagtctggtaatttggtccacctctccttacgtaaatgtgcattcttgatgctttcaatcttgtttcctgctcatggcacacaaaaaaaggtcagcatcgatttcattcttgagcattcctctcatcttcatcaaaatacagtagcaactgtttgttcgttcactaaagtttgtgagaaagagcaccttttctcttagcgctcgaatgataccgttgaaagtagctgccacatcagtgaaattggcaatgcctcctccaattagaagagctcgtttacgcccgtcaggatcagtagtggcacactgagaaagcccgaacgtttggtctgtgaatctctaaaattttatagatagaaacaattaaggaaaaggccaagttctttgccatgactcacatcaatgacaactcttgcatattgtaacacctcttcctcattaggtgctccactatactctgcgtagtttccaagctctgatgcataacctaaatccccaaccttaacaaaagcagataaggacaacaaaaacaaattaatgtgagaaattctttggagtcatcatttgaaggaattttttttccagtcttttgaaatggtaaggatatgagattttttaaaaatcataatctataatctatatttgagttgattcaaccatgaaaattagcatgccttaagttcaggggttgcaactcactgtatcagcatatatgacgctagcaccacctccagctaccatcgtccaaatgcggcctttaggattcaaaacagtgaacttcaaagaagcacttgtctgcaataagtaacaaacacacacacacacacagacatgaatggtcagtaacattactttcaagtctttcctgtctgagtcacaaaagtggtgtttttagaaaagctggatgcttaaaccttctcatctaaaccatggatgaagttctctgtagaactgaggacccttccaaatggcagaggaaattcaatgtctccccacctgtattaataaaacttatcaatccaatgagtttccaccggaaaaattgattgcgggtctctcaccgggaacttagaaatgttagacatacttgttgaaattcttgaaggcagcagtgtcatctaattctcctctcatatccagagggaatggttctccatcgactagtgtaaaaggattcatctccataaaactgaaatccaaatctttaaagaaacacacaagtagataataagaagatgtccttgagagatctcgaatcagagcaaagtcaagaagtggcctaatctaatatactcataccttgaaatacagcaaaggcacccattatgaagttgccgattttagctcgaacctgaaatagatagaagcatttgttagagcaggcatagcatagttcaaaacaacctaaattattaatctccttaaaaaagaatgcaagtactgagcagcctaagttcagactaacagatctttgaatttgcataggattgaaagtagaacaccatacaaagaccgaaaatgtacgcacatcaaaaccagatttctagggttatctaaagcaaatagttgcagggtgccgctggcttactaggaagttaatcacaggggaacagaaacttacctcaagaggaagagttgctattaatggagcacatacttctagcgtcatcgacttttccgcaggaagaaatatagtcttcacctgttgataccagaaaaccaagttccccaggagaaaacaacagaagtgagtcgaaaaagataatgcaacaaaacaagaaaagaagcacaaaaaaaaaaaaaaaggtagtactttgtcccaattctcttctatttcaatgccaccacattcagagaagcttatagtgcatccaagtctatcagatactatagagaggtagtattcttgatcatgaggcacaaaaggctccacaatgaatgtagtgataggtgctttacatccctccatctcgacctgcgactcataaacaaacatcaataccacaacaaaatttaccagctgatctataactctggctgcgatgagtcacctcagtgccgaggcgggctttgacaaagtctgcaacttcagcaagatccagctttagagctaccaaaccacttttcccgcgtttcccaaatagcatatccggtttcacaactagctttgtggacgatagccatgactcctggttggttaactcagtgaaatccgtagattctgtcacctaaaagtatacaacaataaacgaatcacccatcatcagtagttctagtaatcaactaatcatgccatgtccaaagtcatcagtagaaagagatctttcccaagattctcactttcattagctctatctaagtccaagattactctcaataacattcagacaaaacacgattcattcaagagttccaattgaattgtgctatcgaatttccacaaagcagatcgatgaaaacaaaactagaattcgtgagaatgacctgagcagagcgaatctgcaggtcaatattagcaagacgcttcaaatgctccttgagaagtctcttggagtcatattctctgatcttcttcctcgccatcgaattacaaacagtgatcgtcctcaacactaaaccacggaaagtgtttctccgcctgaagtagctgagaagaaaaggtgacaattttcgagacgataagatcgatgaagttgagaagaagatgatctcaccaactcaacgatgacgccgactcggcgggaccagaagagacgttgacgttgagatatcgaaagtcaacctacccacccccgcctaaaccacaaattcaattctctttcctcgagaaccaaccggtacggttcggtttagaagaacccgacgattatctgaaagttggaaccattaatggaggcgtcaatcagaaaacttaaacttgcactcgtcttccactttgatccacttaaagcagctttaaagctttgaacatgtttagctataatccctgaggaactatcctc

SEQ ID NO: 564 - DNA, 3000 bp, Arabidopsis thaliana
ttgatggttcgccaaatgagaacaatccaacatcatcagactctacacacttgaagattcactttggtcatgctatggtggcaacattgattcttcacgcagtgctatttcattagaagtagaagaatatgtaggagtcaaaatagctttatgacacacaagttaaagctcttttagagtatcttcctaggaagaagctaggaatgtaagacattataaatttctttggttcgacggtattgctaaggcttcggatttgtacagaaaacctctggttgatttgttttaaatatatctctttaggaccaaaagcggaaactcagacattgtaacaaagaggtgtatcttaatccttcatacactggagggtactgtctaactattttaatatgatctaaaatgatttcatcgctaattcaacgcctagaaaacgcaactaatatcagcattgacatggagacaacaatcttgaaacctgatttgtcccacaagttttggttgctagaatgatcagcttcatgctgtttttttgcagccaattgctccttgagttcttgtattgccacatcgtttcgctctcccatctaccatcccgcagaaaagcagctcgattggtattggattcaagattattatcccaagtaaaagaaagtgagtgtaccttttgaagttttcgagtttggatgcgtgtttctcgtaggcaaaattctaacttcagcaccttcttcttcagctcctgatcaattctcctttgattctccacctgatccagaagaacaaaggctttactacataaaaccaaaaataaatcacagaactaagagatgctaaagcatgacgtgttgttacctgatcttctaattccttggtcttaaacctccagtgagccgatataatcttcagttcatctctcagtcttgcaatttcatcatctttagccgtcaaaagtttgttgattctttcagaattctttggagtatcttcatttagcatgttccgcacctcagagttctccttggtcttgaccactgatacagcccgcataatgtcaccttcaactttcaaaagctcatctcttagctgcttctgtgaagattctctaactcgcagctcctttcttagattctctagctgctcaccaagtctagttacttggtcctcatgctctttcaaagaaccggtcctctcatgcaattgtttcgaaagcactctacaatgagaatgtgctgattcagctgacaaagcacttgcctctgcagttgcatgtgttgctgctagctgtgatttgatatcagccaattccttcacaaactgcacaataggagaacagaaaagttgataagttacgtcggtaaaggacgtgagatctcctgagttttggcagatttaagaccaaagtcaggttcaaaagacaatggaggaccagcaaagtttgaagaggcagacataagaattaagaaggctgatgagaaacaatcaatgaagttgatgctctaacagatctatgtgttcaagcagaatcaagcaaaactagagaaactggacaatcaagaaatgtgaaagaaaacaatcctaaccttctcagtagcaacatccgaagcacgaatctgctcaactttctcgtttagttccttggcaagttcatgcatttcatcttccattctcttaactcttgtttctgcctcctgctcatattgaaaacagctcaacaaaagtctcaacatccaaaccaaaagactaaatcacaaaaaaaagtaatagctgataaattcagaactttgctaacctgcctggacatagcttcttttgaacacgaccgctcctgttccgcaagacgagtcctcgcttctttcaactcagtggccaaagacaccacatttctcctgaaactctgcttcttctcactcaaatccttcaacaaaggatcatcctctcttagactaacagaagttggcattttctgaaactggaatatcaccgctctgttctttaatctagacagataacttctccagaaaaccccaaaattcaaaaacgtaaaaggaagcagctattcatgttcttcacgtgaccctgtacataaacgaatgaaacacataaatgtccaatctcagtatagttaaagaatgtgaaatcattcaaatatgtccacaagaattaaatcctctaaatcttgtttgtaacaatcaatttcttataaataacagccattatcgaggtagggaatacgcaaaagagacaaagaaacttgtgtcgtccctttcacatcaataaataaactctgataaagacgaatactttacaagtatacagccaaaaaaacgtgacctttttaaaaattcaaaatctcttacaggatttttttaattttcaaaccctaaaaatccaaactttctcgcgacccaccagtctccatcgaacggttggaaatattaggtttctgggtttggtaggaagaagaatcaatttgcagatttgttcgagttcgtgatttctccagaggaggaaagtgacagtgaaaatgaaacctggaggatggggtccctatccgttaggttcggatgagagatcatttaaggaaagtgactaaaatatttagcttcggagttaccgagcctagggcttcgaattttgtgtcatttaaagtaacgaatccgtagctaacctacgcatctggcgcagttagctaacttgctaggtttgactgtagcgcggcaaaatctattcgttcaaagttcaaactatagaaagccacgtgtgcatagtgtaaacgtagtcggaccacttttgcagccatatcaaaccgttggagatccgatcgaatacaactacgaaagatattaaaaagcttttgcatgagtaatgtcccgatttgtgtcgtgttgataagtaagttatctttttcccttcatcctttcctcatactcatattgaatctataaacagaacaactttttttaattattgatggacttttattttaggaatgaagagagttag

SEQ ID NO: 565 - DNA, 3000 bp, Arabidopsis thaliana
aaaaaccctgaggatttttcgtgttcgccggcggtgacatttacgcgcagaaacgttgatactctctctctctcgacggaaaattcttcctcggagatatggtgacggagctggaagagcttgtcgaatttttgtcatctccttcaccgcctgtaagctttttggtttcatctgtttctgagctatggggatgcattgataattttagattctagggtttttgttaccgatgagtctgattgaatgaagaaacaaacttgtaggtgaagaaagctgcggtggaaattgttagtggtttaactggttccgaggaaggtttacaatctctatcaaagtattccgagattcttcttccatcattgtctcagcttctaaatgaaagcaaggtcattgaatcaactcttaagaagcactaattgtttcctgaatttggattgagagatattgaaatgttgttttgaattcaattttgcaggaggtatcagagccagcagctcaagctcttgttaatctttctcagaagtgtgaattggcaaagaagatgattcaaatgggtttgattaaagtggccatggacatgttgtataagccagagtcttgtattaccagattacttgttatgcttctagtgaatcttactcagttggatgatggggtttcttctttgcttcaggtcgtttatcataagttaaatttgtgtaatatatagtggggattatcttttggtagtctaatggtgacgtagctaatcgtgtaaaactttatgcctttgttagattgacgatgagaagatgcatggactacatatcatgaagcttgttaggtcattttgcaggtcttctggtgaaactgctggtatgtacttcccactttagtattgtaatataatttgtccaagtttatatatatatatatctacttctagatatgatagtttggaatttccttttcatatatcacgtttttgtttcatatatctaaatctaatcctcggtaggacagtctagaattttaatgtttgcattggcaccattgaatattatgcgtagttacttactggtagtttttttagtttgcaatcaagtttcatagctactgtataaaaagaggaatgaattactgaatattgttcttatttgcgcaccagatgatcagtttgagcatgttggttcgatccttgtcaacatatcaaaaacagaagatgggaggaaattgttactggagccaaagagacgactattaaaacagatcattaggcagtttgattcaacaaatcaattgcgaaagaaaggggtacgtttaaaaggagtttggcagattactctttaatgaacatgttgcttagtctataccctttgaacaatttaacatggattatgcttatcggctttcaggttgctgggactattcgtaactgttgttttgaagccaaaaaccaactccagaatatactcttgatatcagagtttctttggcccgctctgctcctaccagttgcaggcagcaaggtttgttgattttgctttatagctgctacgttgttgcttacaaaggttttcttcttttatgagaaaatagtttctgattattgggttttactttccttagacatacagtgagcaagatgtcgcaaaaatgccacctgagcttggaagtgcactgtccattgagcgagaaccagttactgatcctgacattcgcgttcagacactcgaagctatatatttgatcatcttagaggtaaaacatttctctgtctcgctttcccttcttgtgaactcttgtgaaggaccaatcaaacccaaaacttacaaaaggtcctctgttatgtcaaaactacttttgatgttgcaggaggcaggtcgaagggcattttggtcagtcaacggcccacggattctacaattgggatacgaatatgaagaagatccgaaagcaatgagagcctatgagcaagtcggttctttggtatgttcactccctctaatctcactcactgactaactctacaggacttaagatagcatctttctcactattaaccgttatttgctgtgccgtttttaaccagcttgttgaggaagctggaggtccggaagagtcgttggagccaacaaaagcagagtcttgaagttcattatttgttgttctccgactctagtccccattattggctgccctcgcaaagtaagttacttatcctgttatgaaagagttactactacatcttgtgcactactagttgtaacactagattcgttattgacttacgcgatcttattagtgctccattttctatttttggttgtaattttattttatattagacattatagtatgttatcttcgttagacaatatatttgtgtattcttacacacattttttgctacttctctaattgttttgaatctgaatcggaaatcaagcagagaagatctaattaaactactaatgagttaatgttttttacatattttatagaaatatcaattaataaacgataaacaccacattattgccaaccccacgaggtagccaccaaatgtgtccacaattgtacagataagagaacagagaggcaaaatcaaatcaatgattttgtttttagacttttatgttttttggcatgtgtttctaatcatattttcaccattcgtatattaaatttttaatatgtagagattgtaattaattagcacacattaaaattgaaaccagttggcgccttgaccattcgtttaaagccacgtggaaaattccgaatagttgggtcccacctgaaaaatcacgttagatctcttcatcatctcctcctctgcattttcttctcctattcttctcgacgacgaaagaaaacaccgaagcaacgaggaagaagaagattataatctaatctctccttcgtgtagtttagcgaagagtgatgcgattttcttctggcggtgtttgatttcgtattctcgagttgttgtgggggagagattgattagaattagag

SEQ ID NO: 566 - DNA, 3000 bp, Arabidopsis thaliana
gtttttcttgtagattctgcaacatatcttacttgatattccaagtcttgctttcttcactacatatgcgcttctggttctcttttgggcagagatttactaccaggtaaaccttgattctgtatatattttcaatttagtttttcctgcattgttgttgatatttactctatcttggcaggcacgtgctgtatcgactgatggactgaggccaagtttcttcacaattaatgcagttgtatacgtaattcaggtgaaactaactacctatttggcctttgtaatatctgagaaattttcaaagtttagagttaaccttgaacttggtggacctgtgggcctgagcttcttattgaatttccttacgatccatttgtgttgtgggttccttagctttaatctttcatttgaatgtattaatttcagattgctctttggttggttttgtggtggaagcctgttcaccttatggtaatcatttctaagatgttctttgcaggtatagtttgaagtatagatcattttacacagagattgatttttttaatgcactctatgtctcatctcttgtgaatgtatattgcaggtgtctcattgtttgcggcccttggctttttattatatggaggaaggtaagtatgttgcacttgcatatgctacacgatgatggtagcttagtttaaacgcttgttacctgctgccacatgttttcctgccacaaatgagttgatgatatcatttggaaaactaggattcctgccctccactggttgctagctagacaagatcctttttgtaccatatcaggatttatcatatatcatttctgttatgaaggaagtttctcatgaagtcgccttgatttatcgtctttgatgattatttctttgcaggcttttcctgatgctgcaacgatttccagtagagtctaaagggcggcgcaagaagctacaagaggtgaaccttgaatattaaaccaaagttaccccgatctttaaattccgtttcttggatccttaccccctttatgtgttgtacgaattgcaggttggctacgtgacaaccatatgctttacatgtttcctcatcagatgtatcatggtaaagatatacacatcatactattgataccattagaccatatcttgttgattgaattctctgtgttggtggatctccgaaaccacagctaaccagatctttcatatcatcttctgttaatggtctagatgtgctttgatgcgtttgacgatgcagcagatcttgatgtcttagatcatccaatcctaaacttcatatattacttggtaagctttccattcacctcttcagctaccatatatgtgcatgtgtatatagacacactatgtgaatcttagaatctaaatatgaagcttcttttaaaaatctctaaacaaaaagtgtgttctgtttacttacagttggtggagatattgccatcgtctctggtcctctttatcctaagaaagcttccgccaaaacgcggtatcacacagtaccatcaaatccaatgaacatgttcagagaatcgaaacactgaggtaacctttactggatgatactataacagagaaaaacataagaaacagctgaaaaaggggtcaaaagataaactgtctttctttttttttggttaaaaccggaagttaatattgtgtaggtaccggtaaaccgaggggttcatgtttctttcatagacaaaagtgtaaattgtaaggggtttcagaacaatggattgtgatttctctctaactaattcaatgcggttgattagtataagtctctcttgtttatactgattcaaagtagtttggtgtgagaatgatagaatcatagttactgagatatccagcttctggttctgacttctgagacggaagaacaattggtattttgatgatatattatggacattggcttgttgtcagttcatacgaagtagttttttaagaaatgcaaatagtcatttgttgactggttggtcttttctctaccggtcttttccacttggttaattgaaagttaggtgatatctgcacgtactaatttcggttattattaattaattacaatcggtattttatgatttttcttcattttgtctgccatgagaatttatgtaaacaaaattttgttcaattctaaatgaagtctgcttaatcgttaaagagagaaaactctaaaagagagctgatacaatacaatacatgtctattagatgaattttgttgtaatatgaatttaaattagagacaacagaaaccgtgaatctcgacttaaaattgtgggattgtttgtttggtcacggaattgtaagaaaatacaaatgtggaagacgtcttcctcttttaatttttttgtcgtctatactctacaacactcagagacaccatcggatcatagaaaacaaaattgtcatttatgaagccacgtcatgtagatcccactataaaagtgacgtgatttcttcttcttcttctcttttgtgtgatctttctacggctaatagtcttcacacgtgtaaaataatcagcagatatttattattactcaacatagaagtggttttgaagtcggactgttgtgaaatagaataacaaattcaaaatttgtagttaataattagtggattaaaaaagtctgacgcgtacgcaaatatcatattttaaaaagattaatgacgcgccaagtcgttatctaactcatctaaacggttacagctgtttcttagcctttctgttttctctgcatgaaccctattccaataaaaaaggtgagatttttttgcatattttgccatagaaggacactttgagagtccttctgatgaaaatatggccaaggactcacttcttcctttattcccacttcagggctcgcttttcacctatttaaaccatcattttcctttctccattttgccgtcatcacccaacaacaaaaccctagttttggtttctctggatctgaagaatctcc

SEQ ID NO: 567 - DNA, 3000 bp, Arabidopsis thaliana
ttttcttttctaaacttgattgagacatagtgcgattaaagtgtagaatgtgattaatacgatagagtagagtagagtagagagaagaaaacgcacatggacgaaggatgggtctgattgtgaagagctgggcgatagggcagagctcgagtcacgacgctacctaactcatcattagacatggcttctccctccgttttgtttttgtttttcatttttatactttgacatcataataataaatttatagttcatctgtttttagaaattccaaaagccaaaaacaaagattacataacataagtcggtaccatgaaacaaacaatatatcatatcaatatatatacagctcaatagttgtctggaactctggatacatttattcatttaattaaaggaaaatttgttagttgccacttttttatacagtatgttttttaatcaaggttttctattgttaaaacaaaagcattataaaaaaacatgccatgtataatcattactgtagatttggtattcagatgtagacagataaattcatgttactcaatagattaacgttataaatttaattaataatttgtagtcgattaagaaaattatatagacttcatatgtgtacattatacgtatacagtaacacacagattagtatcaatttttaggctttatagatgtaagaataactatatcaaattttgttgaacattattagtttttatgtctggtgtatatgtctatatatgtggctgtatgtttacttgcgtatatgtatttgtcgctgtcagattttaaaacagttcaaattatgtgatttgatttgtcaagtgccctggactttggactctacttgttttgttgtttatcgctcgttttgttggattaaaataaattaaatcgaatccatttgatgaactgtcatatggtttagtatatcaataattttacaacacaaagtcactaacactcggataacattattattatactaacacatccattagctagaagcctagaactaaagtgaaaaggggatcttaattagctatcgtcaacatatttaaatcagggaattattattaattacattatctgggagttggaatgtcaaaatcttgacaggaactaaaaagctagcttccaaaaacgttagctattaaattctagctaaggagtaacatatacattttaacagtctttttaaaaatatataactgagatatgtgtatcataaactggagtttgcaaactagttgttcgtattgtaacgttatagttaaaatcttccatattcaggtgcactaatttacatgtttatgactaagtagaagataaaaatgaaaattaagaaccataatacgaccatttataaatctggagattagacaatatgttggtaattaaagagttgttggaagttattagtactattatttggatttcatagtacatatagatcagttataacctttagttgaaataaaaacgttaccgaacatggtctgattaatttccaacaaatgaaaacctagctgataaagacgtgaaataaatatagtagatcatcagaagaagagtgttgccacgacagccgatgcaaagctaagtccaccgaagttgatggccggggctgagcttgttggcttggccgtcgaaggagctgcatttccggttgatccgcttcctgttcctgcgttttaataagaataaaattacattaataatccaaaattttaaaaacttagttttataccacgaaaaatataattctcgtataaaaccctcgcaattcgatttaaatttcaaatatttaaacttctatgtattcataccggtactggtggaagatgccggaggagttttcggggttgccggcggtgttgaagacgaattagtaccttcgttaacacaaaatattgtcgcattaattaggctagatatataagaaataaaaacggcgtgacattaggctaaattaagaaactaattaaaacgacgtcgtagtatggtttattcaccggcgctggttttgcatagtgacacgtcagctttggcgccacaagccttggggagatcgagagcgttttctttagtgaggttaagcgatttgagcatatcaacgttgttaaagacagcgcagagacacgtggcgtctttggctacgatctcattcaacggcatgcaacacgtcgccggcggcggagtcgccaagtgaagatacggctgacacggcatcagtttctgaatacacggcagtgagtgtgcgtctcctcctgcaccgccgctcggtggtgaagtcatctgagcattagacgacgtaacgtagcaaaatacaagaacgacggcgacggcgaatctaacagcctccatttcaaaacgttaaatatctctttgtattatgttctttctatctttagttggttgtgaagatgtgaaagttgtaaaacatgcgtgtggtttatatatgtacacaaggtggttataatttttggtttttgaatttaatccagctcaccagcctgatttttcgagataatcagtttctgatcctatcattatgcattggaaacgaagactaagctctggattaattagaaaatcgttacatttattattacaggagttgccaattttaagagtttagatgtttgttcatatagaaagtgtaatgatatggtaccttaaatggaatgatatcatatatgttttctcacctaacacaatacaacttcttatcatttttttttaataaatatgtataatgtacgattactatttctttttgatcaaaaaagttttgcttttggcagataagttaaaggctaaaaggctgttggatatggacttccacgtaagagcctacacgatgtaacgttacattaatctcaatttgttaaattatagtatcatatatatatatatagagagagacagagagatgcatatgaaattggtttgttgactgtaaattacatcggagaattgtagtgatcggagaaa

SEQ ID NO: 568 - DNA, 3000 bp, Arabidopsis thaliana
attggcctgcgaagtcaaacatcaaatgttatgtttggttgatactcatttcccttggtaaaacatatcttaccttgtcgaaaatccaaaaaccataaagttggtcacttactggttgttagatatgtatgtggcaagatcctttgatatggcataaatctgtcccgtagcatgtcggaaatatttgttaccttcttctccaaatttccaaaactcgggttcacggtacttggccgtcctacacattttgagaaaaaactggttagaaacccaaataaatagaatagaatattcaaaaaaatgatataacaacacacacattaggattattactttttggtaaggacaggaccggatttcatacatccaatgtagacccttggcttagaacggtgacttgctaatgtggaagcaagcgtgcctgaaaaagcaaagaggtgagcaaatatattcaacaattttagttcaaggaaaaaatattataattttttttatgctagaaacatattttggtaccaagattgacgtgaacatcatcatcaatcttgacataaaactcagcatcccactttgcaactgcactagagaagaagcttttggtttttgcagatagattgtaatatccttcgacatgatcctgcaacgagttaaaaaataatcaagaaaaccgtaaaccaaatcctagaagaatcaagtttgtagtggtctaaccagcctaaagaaatcgttgtattgagcatcttctgaatcaatctccttatccaacatactgtttggcgttgaactgccaacacattaaagtaagaatcttagtctacttaaacaaaaaacacacattagactacattgcattcattcacctgtgtccaatcataaatttgacgacaattcccttctctttttccaatttctcaagcttttcccctgtgatagatgacatacaaaagctaaataagattagaggcaatgaagcattgaaagtaaccagagatttgaaggatggacatcacagataccttgaggcatccaagtctctctaagcgaatcgcgacgttttcgactgctaaatgcagtattgataccaatcaccataaaaactttgttcttttggtttccttctgttgaagaattggttgctgagacattcacaatctgttgagggctatgtgtagcagagagctgcttctgaagcatagaaactgacttatccaatgatctgttgtctcaacacaagagtatatgatcatcaaaatattattaatcaacagcaagtttaagattcacacaaaaaaataatcatttctcactcactcgattgctttatgagtttttaaaacctcttccattacatcattgtcttgtgatttcttctgtattttggtgaaatcaaaagattgaaaataatgagtttttttgttttaacaccaaaataatactcataggagaaattcagattcaatgagattaattgttctaagaaagatactttctcatgagcataatcttgggtaacaatcttaagctcctgatcacgccggtgctgtaaaatgagctggctaccggaatccgacgaagctgatcgtaatctgaaaatgcaacaacaacaacaacaacaaaaataatgagaaagcaagaagacatgaaattatttattgtgtaaccgtagaaagatttttttttttttgttaaagtaaccgtagaaagattgatgaagaagaagaaacagaacttggaggtgaagattgctccgaggaaaaagcaagaaatgcaaagaagaggaacccatgtcatagtaagtctcttggagactttgttgttgtgcttcattgtgagcacacaaagagagacgatcagagaagagagaagaaatcttttaagacgtataattttaacaaacggaaaggcaaagttgttactacatgcagagaaactagtaacactctctatataaattaatatttaatgcaagtttgactgtttaattcaaagtatctaatatgtcaattgatttacttccacttatgaatttaaatacatgttcaaagaaatgaactctttgagtcttgactaacaaaacaaattaaataacctgatatggtttatttattgaattatattattatttttcaacgcttaaaccacaagtttgtgatatttttggaaatataagattttttgttctgttttggaaataaaatattcaatattacagtttaggaaaagtctcataaatatttataaaactttttattaacatagattcgtttttagttttgcatatttcatttggttttgtgttaaaaaaaatatatataaaaattaggatcacatgcaaattgtattcactagagaaggagatgcgtgtgattcaactagtttatttatttgacaaatagttttcttttgattatacatttaaattagatgtttatttcgttatgttcagatgaatatttttttgaaattttcatgtaactattttcaattattaatttatttatttattttcaaaaaaaatattttatttttgtgattggtttggtttgcaagtaatatatgattgtaaaactaaaccaatcaaaccgatgtaagtcaccggctactccggttgaaaagtatgcggcttctagaatcagtctcaaagccgtcatcacctattcagccggtaacccttccaaattccattttcgttatttccctcatttgtttttctcctttccccaattctcttcttctcatccatagcttccgacgagagagaagaagcaaagcaaaattcgatcgctctgggtttttgatcttttagggtttctggcaaatttggatggaaacctcaactttatccaaagataatcataaaggaagaagctttcgttgttgtttccattgttgcagctccttcaaaaactcttgtctctattgctttcacagctaagaattctcgattccatcgttgtcgttttcgattttgacgaaattgggttcttctagattttggtt

SEQ ID NO: 569 - DNA, 3000 bp, Arabidopsis thaliana
acgtaagattaattgaaaacgtaagattgtcataaaagtgtggtatacatataataatcaataagtagttgcttttactattttcacttttcactatgtgtaataataccctggattagtaaaatggattgagatattggtaaaggaaagtgtatgctaagcattatcggaagatcccttaataaggaccgcataaactatatttcataataaatttcctattaacataaaagaaatctaaatacaaaaaccatagactttatttaaaaaatttggaagaaaaataataatcaagaactagatatttataacactatctaaactctatcacaccctaagaaacatcgttttcacgaattattgccttataggaccactagtctggcctttattaggtgaccaacgtcaagtagataaacatttatcttctgctggcagtacatcaattatacaaatatagcaagattgcttatgcccccgggtacgggaaaccttcgcacgtggcaaagatcgacagtctctacgtgcaagaatcatggtctcgccatctcactgtggagtcctttaacacctagctaaagtgtttccagatcaatcacatacatatccatctttgatctttttgtttttggcatacaagaaaagaaaatggcgtctcatgctgttacaagcggacaaaaaccacacgtagtttgcatacctttcccggctcaaggccacatcaatccgatgctcaaagtggctaaactcctctatgccagaggcttccatgttaccttcgtcaacactaactacaaccataaccgtctcatccggtcacgtggtcccaactcccttgatgggcttccttcttttcggttcgagtccatccctgacggtctaccggaggaaaacaaggacgtcatgcaggatgtccctaccctttgtgagtccaccatgaaaaactgtctagctcctttcaaggagcttctccggcggatcaacaccacaaaggatgttcctccggtaagctgtattgtatccgacggtgtgatgagctttactcttgatgctgcagaggagcttggagtcccggatgttcttttttggacaccaagtgcttgtggcttcttggcttatctacacttctatcgcttcatcgagaaggggttatcaccaataaaaggtaagtaaaaggttattattagtttaggttttcatcacaaagtatattattattattatttcattaacaatttacattatctatgacacctagaacagaggtacctataatacagatacgtaagaagtaccgtcgtctaggcctttttctgtcattgttagggcgaccaagaataactcatccttactctgaaattaatctatagtattaattgatcaaaattaaatgcatcaaaaatttgcatataatacggtgcttgaatgtttttatagtaaatattgagatataaaattatacttataaaatggaagtggattatggcagatgaaagttctttggacacaaaaataaattggataccatcgatgaaaaacctaggacttaaagacatcccaagctttatccgtgcaactaatactgaagacataatgcttaacttttttgtccatgaggctgaccgagccaaacgcgcttccgctatcattctcaacacattcgatagtcttgagcatgatgtcgtccgttctattcaatctatcatacctcaagtgtacactattggaccgcttcatctatttgtgaatcgggatatcgacgaggaaagtgacatcggacagataggaacgaatatgtggagagaggagatggagtgtttggattggcttgatactaagtctccaaacagtgtcgtttatgttaatttcggtagcataacagtgatgagtgcgaaacaactcgtggagtttgcttggggtttagcagcgaccaaaaaagattttttgtgggtgattaggccggatttagtagccggtgatgtgccaatgcttccgccggactttctaatagagacggctaaccgaaggatgctagcgagttggtgtcctcaagaaaaagttctttctcatccggcagttggagggttcttaacgcatagtggatggaattcgactttggagagtctctccggtggagttccaatggtgtgttggccgttctttgcggaacagcaaacaaattgtaaatattgttgtgatgaatgggaagtggggatggagatcggtggagatgtgaggagggaggaggttgaggagttggttagagaactcatggacggagacaaaggaaagaaaatgaggcaaaaggccgaagagtggcagcgcttggctgaggaagcgacgaagcctatttatggttcgtcggaactaaattttcagatggtcgttgacaaggttcttttaggggagtagagagactacaatttattttagatatgatcgttacaaaattatgttatgtattgaaatttaataaagtgttatcatatatataatgatgaacaagtatctgtttaattattaaccagataaaataagtgttgttttgtttcaacagtaaagattatgcatacttgaattcaataataacgaaacaacatcacttatatcaaaatttcaattttatttcacagtcttataaatcgttggccttattttatgttttggcttgagtgttgaaatatgccactagttttgacttttatttcacctacacctcaataacatctcatcttttgaataaaaaatattatcattttgttaggctttatacataataaatacacaaattcggcctcgagatcgcccacttggaaatcttcacatgcgaggcagatctttcgacagttcccacgtgggaaaatctgatcataaggtcgagccaacacattgttaataatttctataaaacggagtcctataagcgtaaaggaatcatattcctatcaatcaaaaatacaaatcgactttcatattttctctgcataagagagaaagaaa

SEQ ID NO: 570 - DNA, 3000 bp, Arabidopsis thaliana
tctacctaaaaattgattattgttttcttgtctcctagcgaatagaaaagagaaggagtacaaccttccggcctctcccatggcatctttagattctcttccggcgatgaagctcgtgagattcatattatctacccttttggtcacttctgtgaactcgcaaacgcaatgccggaatttcaaatcaatcattagtttcggagattcaattgctgacactggaaacttgcttggtctctcggatcctaacgatcttcctgcttccgcgtttccgccatacggagaaaccttcttccaccacccaaccggtcgttactccgacggccgcctcatcattgatttcattggtacgtttatttacataaggtgtgagtgtagaaaaaaagagctattaattattattaattacccttactctcttttttcattctatattagctttcttgaatagcaagtttgattgtataaaacctaaaaccatctacatacaaccatattaagtgttgttgagcctccttattggttcctcaacttacagctctctcttgtttttttttttcggttatgttcacagctgaattcttggggtttccgcttgtgcctcctttttatggatgtcaaaatgcaaactttaaaaagggagttaatttcgcggtcgcgggagcaactgcattagaaccttcctttctagaggagagaggaattcattctactatcaccaacgtcagtctaagcgttcagcttaggagcttcacggaaagtttacctaacttatgtggctcaccttcaggttgggaagctcaactttttcttctctgtttttggtgtttcatgttttatatgatcaaactatcaaaatttgattttcttatatgcttatattgctataagttgtaatactttattttgctgttttgtatttagattgtagagatatgattgaaaatgctttgatactcatgggagagatcggaggaaatgattataattttgcactcttccaacgcaaacccgttaaggaagttgaagagctggtaccgtttgtgatcgctactatttcttctgcaatcacggtaaacattcttgatcagccagttccgggaatgactaaaacatatttgtatctacgctgataattagtttggtaagaaaaaacacatgtacatgttacgttgttttgaaactgaatgttgaattcaggaattggtttgcatgggaggaagaacattcctagttcctggaaatttcccgatcggatactcagcatcctatttgacattatacaaaacatcaaacaaggaagagtatgatcctctaacaggatgtttgaaatggcttaacgatttctcagaatactacaataagcagcttcaggaagaactcaacggactcaggaagttgtaccctcatgtcaacatcatatatgctgattactacaacgctttgttgcgccttttccaagaaccagccaaattcggttaggcttcttgaatcctccaagagatttcttcacaaccaagtcactcatttgattcactaattaattaaccgattttattatccaatcagggtttatgaacagacccttgcccgcttgttgcggtgtaggaggatcttacaacttcaactttagtagaagatgtgggagtgtaggagttgaatactgcgatgatccttcacagtatgtgaattatgatggcattcatatgacggaggcggcatacagattgatatctgagggcttactcaagggaccgtatgctattcctcctttcaagtggtcttgcctcagctccgagattatgaataagatgtcattagatactcagattcttgatgaacagctactacaaggttgtctgaaagtttgagagacaagagaaagagtggaaaaaacatataggttcttaagtgtttgtgtcttcttcttttttgttccgggtaacggtgttaattagccttaggtgcatcatgcatgtgttggatcatgtattatctttgtattgtattgttttcgttagtttgggtaagagttagtatccttaattgttggaccatgtacactgtcatatataatttaactatatacaaaacaattaaatgcataatttacgcatcgcgtggccaaatttctagaatcaaatatggttttatggtaagaaatcagaacactatgtaaatttgattaacgatgggactaattcagaaaaataaataaatactaagtctaaagaaatagttgggaactggcggaaaaaaaaaagttggagagtctttaggtctaaacacatgttacatgtataaaaggaatttaacaaggttgtatacgtagttacgtacattaggtgtttctctgttcgtgtgtacaaccgcatatttttaatctttggatcatatagtgttgatgaatgtgtacatcaactattggagatataatgtattatgctgtatacgtacaacagaatgttccaaaaatctttcttcttttttttattttattttaaatcggccccaatggtgctataataaacgagaaagccaaaaatactacaaataaaagcctcagtgatgggtttatcgtttaagcgaaagtgacgaaagagaggaaactagacagatacgacagtaagttttggtcatcgaagatacgtattgggatccgctcacaagaatttgttgtgtgtctttttgctaaaaggccaatacgaaaatcgttgataattcgtttcatctaccgcaatcactttatccttgaccaaaaaaagaaagaaataactcaaatatcaattttataatcaaataaaaacttaaataatcaaccaatatacccgtgtgtgtcaaaccatactgcatcccaataattgatcttttaatcattctttattatcttatccttggtattgtggctagtggggtattttcaaaagacttttttgacaaatcaacatcacactattaaaaaagggatctcgacggagaccaaccttcagctctctggca

SEQ ID NO: 571 - DNA, 3000 bp, Arabidopsis thaliana
gtggttaacacctacgctattgggtccaaagagatcagatgttatggagactgcggctgcgaatatgaaacctgaactcagaccgattaatgcggttgcggtctgcaatgctgtttgttgtgaggatgataccgctagtaaaaagaaagcgattggagttggtaagagtgcgattgcaaaccagccggttcttgttaaacgaaatctcctgcaagatccaatattcttgatgagaatatgttatttcaatttcacattaagacattccttaatctaaaatgaaacttacttgtgcataaaatctggtgcggcagagagcaatctaccgaagaaggagaatgaagagtagattgtgactagtgtagtagagttttgtcccaaagactgagcaatctgtcccaaattgttgctgtaaacaaggccaattgtgccaccacagaaatacgcaatgtagtataaccaaaactccaatctacttatgagcaatcgaaacgaatgttcatcaccgagcctcactgtgttcccttccttagcagtccccatatgttcatacccggttttgctggaaacggacgttttttggttcttgagctcatctatgttaagcataacatagccagagctttcatggtttaaacgagcgttaatgaccggaagaaagtaatcccgagcataaacgagaagaggagcacacaaggggaaaaccagaaggacgacagctccaatgaaattcaaacgcgctgatgaagtactggaactagataggagaaggtggaaactcgtaatgacagctaaaacattcaaaatggtaaacacatgggagtcatgtctgcgggaatcatagtccggagtagtatctagagacggtttagtaagaactgggtaaagagcagcaaaggaaacaacaaggggaaccagagagttcagcagaaggtatagattggacgacgacgggttaattgcattgaaagcaagggagtacaatgctgcactgattccattgaagcttaccgttaaagataaggcgagagcacgattgttcgggaaatgacgaatgcagaggatgaaacatgctgtgttgaaccaacagatacttaatccagctaacaagcagcagagaaacacctatcatgttgaaaagattcaattactaaaccaaatcaaatgcagttctctcacgattctaacaaactaatctaccaattccacattcaaatcagatccttgaagcaacaatatcttagtaaaaactaacaagaatttcgtatgaatctttcgaattcaagtagttatatatatgtaccagagaataaggcaaagtgatgatgttggtgatgactagccactgaacaccgtaaccaacaaatcccatagccgccgcagcgaaaagaacgacggagagagggaaataacctaaagcaatcccagacgaccatccaaacgctttccccaaatcagaagccacggcgaggtaatttaacctcacctgagaaattccgagaactgatttgagatgggaagagtaagctgagaaatcgaagttggttcccgtcgatgcttggatccagatcgctgccacaagaacagtccatttccgccatcgaccgaacatggtcctgagaggcggaagatgtttccggtgaaactttgtttctccgtcgtcgaaggaggctcggttaggtcggagtttatctgaaacatctctgatacgaggtctcatatacaaaggaagatgattgatgttgaccgatgcttgcaaaaaagcgtttagttgttcatctaccgcttttgatctttgttcaataaaagggattttgggtttttgatgttaatttttttattttattttaacaagtgtcgtattttaaatgttttaggtaaaaatggtttagttggtattgatttaggcaacactatttattttgctttgaagtgtagaaaacgtaaactgtcaaaataaacgtaaatgaaaacaaagaagtggtgagaattaaggaatcttgcaccttagactaagaatcaaggaccatgtcaatatcatatggtttagaccaacgaatttcttattggcaaagcatttaaatttattatagtggttaagattggtatggttatgaggatgaggtagcacaaatgatgaacttctaaattctaaccatccaaaaagaagtattttgaaggtttcaaagctacgattcttttggtaagaatctacgaaggtgaccaacaagtaagtaacatagagcctcattagatcccaaattttgtaatcctttggcttttgctataccataatcgcaagtatcttcctaaaaatcactatcggtggagtgattaagctaaaatggagctgttaatttatcattttccataattcaaaacacacatgcttgctatctttaaataacacactattgaaacaattttggtagatcaacaccaacacattttattttgacttttggcaaatttatccttcacttgtaacaacaagacaaattggttcgtttttttcgaaattatgacttggcatctacgtggcagtggtttaagtagatgacagtacacgcaaccgctgaagcaaagtttcgttgggttctcttctctcacgaatattcttcaataccaacaaaaccaattcaattcgatttcccagctgtcactcttctttttcaaacgaccttttttttttaatttgtttcttcttcttctttctaattctcctctcgcgatttagctttattcaaatcaaaaatctttaatctttctgttaaattctcgtctaaagcttcctcctttaaccccctctgtatcgtggtatgtgtttgattctttattttctctgtagggttttgttaaattttcaataattgatcgccgaacagattagaaacttgtagttgattcgaaattagacttctttgttgtttctgattaccgatttaggtttttgtgtgtttgtaagtctaaagtttgatgctttatgattttcttgatcag

SEQ ID NO: 572 - DNA, 3000 bp, Arabidopsis thaliana
tatctttgtatttagacaacttttccaatgatttttgtacgaacattattcctttgtctaaaaacgaatcttagaccgtaagaatatattgaccgtttacgaaactaatgcgaccaataagagaaacttaaaatccgtgtgtagtgacgttaaaagtctccttttatgaagttacaaggaaactacatttgtgcacatgtactatatgatgtatataaaaatgcatatggcaataatgcctatatatttcggaataattactttatgtacaatcttggcctaacccctttttccaagcttttgacaaaaatgtacatagaacccggatttcgatagtgtatgcgtatagactaaagatgactaaagacttttatctctcatatagtaatataccaaagttacgtacacatatatgtacacgcatgcctcatagtttgactacgagtttttctgttttacactttcacgcgtgcatcactttttgttttcccatcttttaccgtataacattagaattagaattcaagtcgaatatcacattacaaaattacaaaaagagtgaacaaaattaatgcattgcctttaatatgaatattaacaacgatgttttggcatgcaaaatgtcaggaagcttcgtttcttatattaaaaacacaaacaatttcgtggatgacaatgtaaccgtgtgtgtgttttaaagaaaagattactgttggccgaaagagaaatcgaaattcattatatagttttaaaataaggtttctcaatgaattatcatgtcgcattcgtatgtccttgtcgaggaaggagatgttaattttcttgaatagtttcgtgatatttgttttgtaataagccaaaacgtgctgactcatttacacttattatcctatttaatttctcatacgaaagttataaattaatgaccaaaaaaaagaaagagttataaaccaataactcgatggtccacaaactaaagtataagctttttttataacttgtagtgcccttcatggataccaaaagagaaaatttgatttagtgcatacatataacaatataacgccgcataataatactgtataaaacagtcatgtaacgatatgacagcagtaatacagttccaagagacgttataatcgtatgcaatcatatgcttgcgtagattttccaacagttttgtttcgttgataggaggaactcaacactttagggtagtgattggtagacactattagcacaaaaaatattaattttactctgatgtttaccaaaaaagttaccaatcaaatatttaagagatcgtactcttccacggcgactctaaaaaccaaagatataggttagactcataactactttataaagaaaatgtttaacgataactaccgagatctaataaataaaccttcattttcaagtatattatatttgcttcttttgtttatatatcaaaccaagttctggtttataaaaatattagataaaactcgtctaaataggtaggtgtaaaataaaattttaaatttttatcgataatatttaaaatttgaaaagttaataatgatccacacattttttctaatatttaatttagtaatttttgtattaaataaaatttcaatcatatacattcgatttttctatacattttaactatctatttctgcataataaactgtattttcattttatacgcttcatcttattgatgatatttaaattttaaatagtaattcatacactttttaatatttaatttagtattttcttaaatccaaattttaatcttacaatttaaatatctactttaacataatacaaatacaatttaatttcattgtattaaattcaaatataatttgattataataaaatacaatttaattctaaaaagtccatcttagattttaattttcctttttagttttgaaaattaaaaatttaaatttattagatatatatgttactttttcagttttcctatttatttaagaaaaaaatattttttaacacatgtcaacttgtaaacaatagactgaacacgtcattttatattatgtttagttttgaaaattaaagttaattaaatatttatatttcttttttttagcttttctaattatttttaaaatagtaaatatttttaatacaaatcaatatctgaacaatagatttgatacataacataatcctataaattattaacttggaaaacgatagtttatataataaaattattttcttaagttctctaaccataacaattaaactatattttagcgaagaaaagaagagaataccgagagaacgcaacttgcactaaaagctaccactttggcaaatcactcatttatattattatatactatcacctcaattcaatcgaaacctcaaaataacactaatatatacacaaagaaacaacagaataacaccgaagaatataggtttaggaaaatccagaatttgttgagactaaagagatcaaattttcgatacaaggttttgctcaatttgtattttcataataaaattctttatttcaccatagacttacatgattagtttttcttttaataaaaaaaaaacacgcgacatgaaaattatattatctcagtgttgtcgaatttgaatttgaattttgagttaaatactacacatttgttgacaacttattaaactttataagtctgctacaaatattgtcaaatatttactaattaatggaccaaaatcctctaacttgcaaatttgtatctacatcaacttaaaaattaggaatatgcgacccaaaaaaaaaaaaactaggaataataataaaaaaatggaatgatgtggaggaagctctttactctttgagaggaagtttataaattgaccacacatttagtctattatcatcacatgtattaagacttgacaacttgtctttctcacaccaaacccctctcctctgtttcataacatctgctctttcttttttttcctaagccccta

SEQ ID NO: 573 - DNA, 3000 bp, Arabidopsis thaliana
ggtacattgggtcggatctcaatgggccgggttcggcttgggctctttactggcctgcccattccaagtcgggagttgagatatcttctgagcgaaggttcggagccaatatctctttagagcggaggagaccgcgtgaggctggtttcacagagcagcgtccaccttccgttctcgacggtggaaggataacgggcccgttgtcttccgagcccactatgacccattaggccgactccaactgagccatcacttttttttggatcatcagggctacaaggtacacaatttacttactcttaagaggaaaaaatctataactcttgtatttacatattcgttttttcagcttggaagtcggaactactaggttatttggatatgaaatcagttaaagactcattgatgtactacgccttcaatacattgttaataatgctattagttttcacatatattggtggctcatttgtacgacaatcataagagagcttcaaaacagaggagaagtgggagaagagataagatcaggtaccaattttctttcaattgttgtttttaagattgaaagttttgcttataagggatcaatggttgctagaatctgttacataaacattgaactatcacgcatacgaatcgttaagtaacttgacttatgttatgtctttgagtgattcctttttataatttacatcaatggcagattcggaggatgatgactagggtttgctagaggtcatggtgaaaaatggttttcagatacctcagaattaatgacactttaagcattgctattactcagatatgtcttctcttttgctctaggttaatgagtaatatatagcaaagaaatctatttttattgtaaatgaaaattaaaccccttttgtatgggtaatgggttaatgtaatttagttgagagtccctgaaaaagaagattgtcttctgtgtgcgtgtgtgtgtttaaactcttttgtactttgagaagaagattaaccaaagtctgagtggattgatcaaaaaccatcaaaccacaataaaaaatcgattaaaccaaattgttgcttgagttgagagttacttttatagtgtctcacatatggcaaatctgaaaatggaaaaaaaaaaaaaaaaacaaagaaacgcgccaggtaggggtcgaacctacgaccttctgcttaggaaacagacgctctatccactgagctacaggcgcttttttgaacaatagttattgttgataatatttaatcgtatgcgactttaggcgcagttgagaaaataaagacataatgtgtgtcacacattcttttacactgtaaccaaattagtacaaagaaacgtattctgtagacaaaaaaaatggcgtggtgcgatattcttgtagtttttagtttgaccgtatcttacaagttcatgtagttttagactttaaaattaaggtaataataatttcattagttaaataacagcctagaaaaagaagataatcaaaaaacaaaaagaagaaaagaatcttctattagattttgggttggctgattttcgagtcataaattatttcgattctcagctttcacccccggacttttgggcccttaaatttccaccatcaattttcatattcctcaaaattacatcatctactttcgaattcatgcttaaacatacatttccaattgaaccattcatttaaccgggattaaccacaaatccgcgtttactgtaccgcgattgtgattaacccgactaatacccagacccgttaagaaaacgacgtcgttttcatttcgtttaactcatcaaaaagagaaagaaaacgacgtcgttttcattcttcttctttaactctcaaatcgatttggtagtcctcttcttttgactttcatctctgtctccatcgtcttctagattgacgtctccatcagacgctatgtcaccatcgtcttctctattctcctctccatcagaagctctgtctccatctatcccgacgtcgtctccctcgattctggtggcttcgtcctcctcgactccgctatcaccactatcacttccatcgtcggcttcaatgtcactctctggaggttcgaaatcggggtcatctggatcgctttggtaaatcaatccttcctcccaccaattcttcatttctccctattcgaaacccaaatcgagacccaaaaattcgaaccgaagaagaaaaccccaaatctccttttgtctttctctctcaagaaccctaatttcacagtgtcgagattaaagaagaacgactaaatcgatttgagagttaaagaagaagaatgaaaacgacgtcgttttctttctctttttgatgagttaaacgaaatgaaacgacgtcgttttcttaacgggtctgggtattagtcgggttaatcgcaatcgcggtacagtaaacgcggatttgtggttaatcccggttaaatgaatggttcaattggaaatgtatgtttaagcatgaatccgaaagtagatgatgtaattttgggaatatgaaagttgatggtggaaatttaagggcccaaaagtccgggggtgaaagctgagaatcgaaatagtttatggctcgaaaatcagccaacccttagattttatgtcgtaataaaagcattatttgaagaaaaaaatcatatcttttggtttttaaaccccttatatagttattagtatgcttctaaggtaagaattgattttttcctatccatcctagagtaagagttgatttcttgttcaatagctagccgttccgttaaaaacaatggaatgaccggtttgggtaaggactaaccgggtttggcaaaccaaatgccgtaattattgcagacgtgtcacaatggaacactcagtggcttcttgattatatttttcgagtttcgaggatcaaacaattcaatcatcatcttctacctctgctccaatttctctgaaaacaagaaaaccttaatcaatcgaaatctcagtgtaactaatca

SEQ ID NO: 574 - DNA, 3000 bp, Arabidopsis thaliana
accaaaacactcttcttttatccactcttattgttttaagtatccattcttcttgttctctacaacaaacccaataaacattcttctttcaccaaataaacactcttctttaacctaatacacactcttcattttacccaataaatactctttttcacaaactaataaaaatttctcacttaaggatttcacttaagaattccactattggacagtaaaaattataaagtttcaaccaaaaactctaaactctcatttactcaaaatttactattaaaaaattgtaaggagtccttaattaggactcctcaatggggatgctctaacaagtagtataatttagatacttgcaagtacaagtcaagtaacaaataattgaaaaaaaactaatactttatgaaatttatttttatattactatatgaaatttaaatatagtttcatatagtaatataaatatataaattattctaaaacgatttaaatcgttcagactacgactaaatgttttaaacgttatggcgaagggtcaccgaccgcgcttatcactttcttaaacaccgaaaaaatctcatagatatgcataatacaatgcaaggaagttcacctagttaatataataaatcaacgttaaaagaaggagctcgatcggtatagtaatattatgattgacggcttgacgctgaatcatgcaaatctctacctctttacaaggaatctatgactaattgactatgagactttctcattatttttaaaggtactttgcttgtctctctggactagtcaaattaaatcttgttatgtttttttttattagatccagaagatgtgaataaaacatttaagatgataatatatacaaaatgatcaatgtccaacaggatattacatattgttggatttaaatcaatctttgaacatacgtaaacacacttaaccgaccatcaaagctaccgaaaccagaagatcgatataccttgtgtatttatcttctccaacaatgtatatcttgttgtatatgactttctcaccgcaaacagcaactttcttctcttcgtcaatgtggaaacttagggaactcgaaaacaaacaaccatggggttttaaatccactgtctcaatctcattggtcacccttatatccatctttagtttctttgcactctgatataataaggagagatgttcttctctaacaactgagagagccttaatatcatttacttctgcagcttcttgatgaaagggcacacatagtagttgaaacctctctgttgaaaaaaacaaaactgagcaatgagtaaccatttcccttcaacgacttgccagtggatactaagtcgtcttcgggagagacgacatcaagaaactcctccataaattagagctaaaatcatagacttccaagcatatatctataaacctcaagattttgtagttatggcacaagtccttgttattgtaaccgagagcatagacctcgaatatcttgtcatgacgatttatcggttggatccatatggttttcttctagaatgggtcccaaaccacaatggtaggttcaaagaaactatcttaacaaaaatgtcctccaatggtaggttctcaagaaaaaaaaaatcaaatttttgcaagacaatatctttcaatacaaatacaagtattcatacaaccaaactcatacaagttttggtatctatcactttcattaaacttgtctcttgcatgctgcttctcttcttcttctcaatatcacttttcactaaacctaccactttccctaaatttgtgtttgacacactttcccggaaaaagatttctgcaaaaaaggtttcagcatcattgatagcatcgagctcctcctttggaatagcccttttctgtttattattctcagcagcatcatcatatcattgttatttgggattttcttctctttatgttcttctttcttttctgtttcaacttgatctactacatttgtattgcttttaaactacgttatctatcacacaataagaatgtcaaacccatcctaaatcaaaattctgattctctttggttgcatccattttatcttctttaggaaatggatggataactttatattaaatgacgtcgtttctttgcctcattttgggtcagaaaatgctaaagctgtaagcccattttatgttaatggactaatatgacatcgatttcactatgtaagatacgcaaagaaggcttagtcctagacatattccatagggcttttatatagattgcttaaaatatatattgcttcaaggttactgattcatcaatagttgaccctctcgtgcctcttcaattctaagtctaaaactctatacaccatatctgtcgagaggaaaaattggcaccatttatcaagacacctcggaatccgttcaccccaatacattatacatgttgacaaaaactatcatcgttgtataataaaatagtattggtgcaatgaaaatgatggtttaaatgaaaagaaatgtggcttcctgtaaatctatagaaactgtattggaatagttcaaaaacaacagtattttattaaaaataacaaatttaatagtacagtcttaagaagtattatgtaaagattaaagaaaattggtagcctaacaaatccgagttccattctcttttctagtatagtactagtttaaattgacgacaacagtgggccaaactaaactatagtggctgcgcttatagatcgagggcgaaaccgtcattttctggccttcaataattatgtgtgttgaaaatatatttattaagaggtgaaaaagagggaaaaaaacaaaaacgtcatcgttctcattggttaatatggataatgatctaaacatgtatttgctacttactgtaatatattaggatgtgctttaaagttttataaaacatcatcaattcatcagagtccctcatccatcttctcatcctccaacgcgagatcagacttcgacagagagtgcg

SEQ ID NO: 575 - DNA, 3000 bp, Arabidopsis thaliana
ttcttatcccttgtgctgtaaaagtaccattccatgtcgtttcccggcaaaaatgacttttctgttccgcgtattatccaaataaataactcataaaacctccaatatcatatgtatgaatgcatcatgaccaatatatgtaatctataacgtcagattgacataaacaagctgaaccatatatagagagagatataaagagttggatcgtaccaggcaagtcccatggctcgcatttataaagatcaacttctgggatgatctcgagctcaatggcttggccgttgaccttcctatcaagatagtaagccaccagttcttcatcagtgggatgaaacctgaatcctggaggcaaactcatgggcgccattcaaagtgtatgcgttagaaaacgagagagaaagagatgagagagattaattaaagtgattaggatgttcgtacgacatatgaaggtgactatatataattaaaaagatgagactctgaagaagatatgatatgggaatgtgtaaaagtatgccatgggattggcatcttctgagattaatattttgtcttactttgggttgctttttggtcagtgtttgtcatgatactcatcacacatattttctaaaaccaatatatatattttaaataaaaacctaactctggcttttgaagattctgcaagtgtgaaaaccctagtaggaggagagacggaaaaagctttagcaagaaggccccatctcacaaatactcacatatatgaatgtatatgcttataattccggttagaccttaacgtgggtcatgaatcattatagagggatttttataacgtttgctttaaaccaaaaatgaaggctttttatgattcaacagtttaggggacccatctcttcttctcaaaccaaatctacctggcgacacctaaacactcggctttttcttttctttttttttcggtttgacagttttgttatattgttttatgttgttatggtcttataataagaatacttataaattgaattcatatatatgattaaaaaatgggagaataaaaaagcaggaggcatccaagtcgactttggctttagtgttgggaggcttctttagtcccttttacatatggattaaagacgttgttcggctcttttacatcattactcccacacaatctttgactctctttctctcggcccttcaattttactaacttccggtcaaatctcttttgcctcgactctcggcctcgatccaaaagataaattaaaaaaataaggacatcttcattcttcacatgtatgatatatataactcatgtcatatattagatgtctcgtttacatggttttttttcgtttgctaatatatataattcacatgtagacgaagaacattgtaaacggaatttaacagaatgaagtaatcaaacgttttatgtaaggaaatgatcaaatactgagggagtccacaagttgcgacatatataaaactcctccattcttataaagtataatattcaaacttcaagtaagtaactctcccttttccgtgagaaagaaataacaataacattttagggaagctttaagatgtggtcaccaataacttagggagagagagagagagtgacagatacaaaaaacaaaagatagcaactgaaaaatattttggcgaaagatgctttaacagtttaacttatcaaacgacaacaacaagacatgccccaattgtttcaccactttgtttttcttggtcacaaatcgagtctaagtctatatgaacaagtaattaatgtgagtactatatataaaaaaaaatgtgactatatatataaatgttgtatcacaaatgcaaaaggaatgtggattaattaattaataaagacaacgaggaagctaacatgcaagcctaactaaagacatgcaacctttgatacgatctaaggggaagcgaataaagctaattaagatctaagcatcttatcttatcaacccttttatatttccatttcacatgtatcaagtacctatactctttctcaagcttatagtattgatatctagagtatcaaataaacattaattaattagacgtaacacaatagtgacattattaaatgaatagtaaacaaactttacgtgtatatatatccatgacgaaattggcaaaggcgggactctatgggggaatcatgataatacatacatacgatatacatgttgacatgtatcatgtatcatgataatacatacatcatcccttttttgttggtttgttaataaaatgatcatacatcatcttaaacatcaacatcaatcacaattcttctaaaagagaagaagagtcttgttcagaaaaagtagcatctgattccctacatgtcggtttccaaaacatattttttttccatctcatattagtttgtgctaaacaaactgatccaaggaaaaaagaaaagcctttaaataatacaagttggaatccctgtgtctctagagattcttgctttcatgttttttcacgcatctcaattatagcagaagaacaatgtcactgtccaaaaacatttgcgttatttgccttttgcttttctccatgcattaaatctcatttctacccttgttaaagtggtcacactcattactctttttaatatactaatcctacaggaccacctcgtgattgttatctcaaattttgattaattattcaatcaattagccaaagcagatcttcttcaattttaagattttgatgattactgttaaagctgactatcactgcggggaattcaaagatgatgctagtatacaaaaagagaagcatggtttcaaattgcagaatcaggcccatatataagtgggcttgattatttgggcttttggaagagtgtggcccaacatagagatatagagctgttatcgtctgtctttcatggcggagcagaggtgatcgtttcactattcaatttcactcgtcgatcattaccaacctctgcgggcaaag

SEQ ID NO: 576 - DNA, 3000 bp, Arabidopsis thaliana
attaaaagttattttctagtacaattcgcataatgataaaatatagaaaatccaatggtatatatgactggatctgtatcacaaataggttacatacaggttgtaaattaacgattacttacacaactttgccaaaatattctttaacaaaaaaaaaaaatcattgccaaaataatttccagagatttcattttcattcattatgtgagtcaatacatcggtaagataatataaccaacgacagttgtggatgtacgtgtctataactataaccataagaaattagatgatttgcaatatctaaaattaaataaaatatatttgtccattagattctccctttagtaaacatatttaattaaaaactactttctcttgaaatatgttatcttaattttaaacatttttatttgcatgttcaaattgatcactataaataatccttaattagaccagttaaaaaaagatttatttatgtacaactttccgtctttcccctaaaggttctgatgtttagttgacctggtcgagttgaccagacccaaatctccaggtcacgccaatcaccatcttgccttggccacgttaatttcacgtgtcactttttggctagccaattgttgaaaatagagatattcacctctatcaaaaactgttctttttattttttgggcaaaatcaaaaactgttcaattttataaacttttgacatattgaattatagatatatacaataacagccgtaatattgttttaacaataacagtttgattagacatcgaaatcagaccgcgaattctcccaaaggacgtttaatttttttttgaaaaaatgacaatgatcatattcatccggagatcttggtgaaagtcatcgaagggatgctacaactatccccgaatgcatgcttgcagttccgtctaatattgaatgcatgcttggtgtaatttgttttttattcaaatttgattcaatttagtttattttgactaaatgatttaagattatttccttgtagtctattctggctaacatatttgatgcattttcttatattgctacttgttaattaattacataaagattaaggatgtattaattttaagattcatgagctgaaggagaacaaaaagagttactatgccatttgcgatattgatgatacttgcgcttctaccacgtcaaacaagaacgctgaatactaatgcgaccgcagcgggaagatgatggcagtggccatgcccatgatggtgatccacatcaagattttagatttatatttctatatatatttttaactataatttttagtttcattcttaaaaaaaaaaaatttggtaaaacttttactagaaattcacatatattccatcgtcactagtttatccctagttagtgcaaatcacaattcgtttttggtcaattacaaaacaacaatgcatatcattttctacattaaaaacaaaaaaaattgttagtaaaaattggtatgtactaatgcaaaaatttcgagacttgaaaaagtttacagcaaacaataaaagtatagatagttgatatatagttcaatcatatttattctcaataaataaaaaggtaggtaaataatcatgagtgaactaaagaaacggtagaaatacaattgtcaccatccaatcacatttaaggtcacatttattaacaattacagctggctggatcatgattcatgacaaattgtattcaacaataattttacagtctcggttcaattataaattattctcccttttttggcaatgataaacgagtcattttcggattaacgtatatagttaggtttttggtcaatcttacgaatttgtacgctgtctattgtctacccaatatatggtctttcttcaatcattttcaaacaaattggaaacaaaaggaaaaagtctttgaatgtatgcacaatgaaaacatcaatgaatagggaagacttcattacaccaacctaacactcgtgcatgctatgtttccttgttgtgcgagagcaagtacggtgaacatactctgccgctatggctcttccacaaatcaataagtggctggtcgtcttaccatcttatgtttcgggtatactggatatcggaatccgttccaaacaacctcttatagatatcacactaaacattactaaaagagatcaatgcccattataaaacatcaaaatagagagatacatatttcacagaacatcaccgtagaaattcattaaatttaagagtttactcgctcgtatcatccaatacggttggtttttctcttaaacgattcttaagcgtcgagagtcttttgaaggccgaataacctttgataatatattccgtaatgcatactttattacgctcaaaattcttcattacatttgcaattttattatgttgtgtttcatttgaaatcaatattatgagttttaattaataatatcatggtattcttataaattatggtatcaatttgacaaattttacgtttataattttcgaatctcctaacaagcagtcaataatattctataaataaccaagtggtcgtgatctactggtttccacttgaggaggaattgccttgttggtctaggttagggatcgattctcctcaagtgccaaattgttagtcatttccataaactaaacgaacttttcggcgttttttttttttttttttgggatcttcgtcataccctatcataattcaaatacggtggtagtaatgtgtgtgtaatttatagatgaaagaaataatattaaataaaaagcaaatgtatatattttatggtatactaaagttagaagttttaaaccatttcacatattaaaaatgaaaaaaatgaaaaggcaacacatttttccctataaataccccaaaccgactttaatcgccacaccattcataaacacacaccgagagaaaatcagaaattaaattagagagagagcagagtgaatcaaaacttcaacttcacccaaaaag

SEQ ID NO: 577 - DNA, 3000 bp, Arabidopsis thaliana
ctctctctctctctcacttctcctcggatgcactattgtccgtgagatcagagattcaccctctttagattttgcgcagaaacttttgcccacaattttgtattcgtcaaatctgagctgagatctctagagtgagaaaatgagcatcactaatgaagaagcagtgaagcaattgcgtgctttaatggaagatggtgtgtctttatttgggttttcaatgttttaacttttaagcttgctttgtttgaagatcgctgacgaaatctcaaattttgagctaattttacttacttttggtattgacagttgatgattcactcagagagtcgtatcgggttagtaaattcacttgttttttagatgctttgaaagattcaactcccaagtctttgcttattgaaccaaagatcgatactttcgattttctataaataggtttctgggaaaaccgggaaaaaaatatccccttttttcgtgtcctgtgtaatttgatcggcatgtatattggtttcagtgatctggatctaaatttgaatcaaagtctctctctttgcattagttatttaagattcagtattgttggatctgtggagttgttgtttaaaacatatactgatctagagttggttgagtgtcatatgtaacatggatcttattgttgttcttggctatagaaaagcccattttgtgatgtagatggtggatttacaaatgcttgtgttatgctgcagaacattcatcaagggtatccgacagagaatttgttacgctttcttaaagccagggatgggaatgtccagaaagctcataaaatggtttaaatctgtttgctttcacctaatttagattgtctttgatgctttgtttcttgttttagctttgttttggggtttaaaactaatgactgcaagtgttacagttgctcgagtgtttggaatggaggactcaaaacgagattgacaagatactaactgtgagttttctttcagcttttggtgtccagttctgcgattttctgtggccctttgatctcatttggttattgatttttgcagaaacccattgttcctgttgacctgtacagaggaatcagagacacacaacttgtcggtgtgtctggttactctaaagaggtactactattttgagtccctttctttctttaactttttttttaattttaaaagcagatgtttgatccaactaaaaactttgttgaatcatttgacttttagggtctccctgtcattgccattggtgtggggcttagcacatatgataaagcctccgtaagcatctctattcatcttccactcagagacttgttgtgaagttgaaactctctgaccgtagctttcttatccttcattcaggttcactactatgtacagtctcacattcaaatgaatgagtaccgggatcgtgttgtattggtaagaccaaaactctatttgggtttagccttttcctccctacttttattttcctatcttgattttgtgattttctcttctgtagccatctgcttcaaagaaacagggacgaccaatttgcacttgtttgaaaattttggatatgtctggtttaaagctttcagctttaagtcaaattaaggtattaataattgcattaccttgtgtgattttatgactttgattcttgtcttcaccacatgttttgtttttttccttttttcatttctgtgtgcagttaatgactgctataacaacaatagatgatttgaactatccagagaagacagagacatactatgttgtcaatgtcccgtacatattctctgcttgttggaaaaccataaagcctctgttgcaagagagaacaaagaagaagattcaagttctgaaaggttgcgggaaagatgagttgctaaaggtaagcaattcagtttccccatgaagaagaagtagtcttactcttgtgcaagaagactgaaagttcttataacctttttgatattgcagataatggactatgagtctctcccacatttctgtagaagagaagggtctggatctggtaggcatatctcaaatggaacagtagacaattgtttctctctggatcactctttccaccaagacctttatgattatgtcaagcagcaggctctggttaaaggatcaggtgcaccgatcagacatggttcagtccacgttaagttccctgagccagacaccgaaggcaacaagatcttcgataccttagaaaatgagttccagaagcttggaaatgaccagaagatctgagtgatctacaacccttataacacgaattgcccataagaaaccggaatttgtctctggttgatgagcagtatttaagataagaatcaatcacctttacttgtattactagtttcgcttgcatcagctcgatgcaggttttgtttaaaaagaagatggaacacaatttcctcggaatggatcttttgatctagtaccattatatatatagaactcatttctatttatgtccttttgcaattctctgcattcttctttagtcactagagtgttctttaatatcaccattgttgcagacccttttatctcaattgtgaaaccaagatctctgcaacatcattggtcatacactgagtggatttgattcaatgataatacaataaagaaatagagattaacatagctactctctgacttttcatcaccaaccattagtctttttggttgttgataagataaataaataattgtactctcaaacaagatgatcgtcgacgctatctatctgtccttatttgactgaaatagaaagtagaaacatagtagctgacagttccaatgacgtaagagagtgtctcgagatccacacttgttcttgacaatgtccagagttatagccgccactaaattcggttcttcttgtataaaaggcttaacctttccacttgtctgagagaccacttctcttatccctctcaccttctcacttggcaccgttgcagagagagaaccaaac

SEQ ID NO: 578 - DNA, 3000 bp, Arabidopsis thaliana
gtactcgtatggagcaccattgtcaactggtgctcctaatgtcggcacttgagggagttaccagtcttccacaaggactaaatgtcaaactcttagccatttttggtagccaacggacatgattctccaagttctataaacagtgtccaaacttggacttgtggctacgttgtgttatgtagagtagtaggctttttaactttattaggtggaaatagtattttcattttgcaaacactcaaacaaagttagatgagtaaactcaatgatgtgaaaaattggaaaaggttttcttttttcctttgaataacgatttttgaggaagctgaatgaaaataagattctttgttggtattctgatggtggttttctaattttgacgtcgtcggcgtcttgttctacacagagagtctctttgttctcgttgcttccatcttctatctatggctgtttcagcttctggtcctgtaaacactccctttcgtctaccaagtcttgaaaccttagacccattgcctgaagtcaaatgagaaactcgtctctgaggcttccgaggtatgctcttcttcttaaccattctcagagcctctattgtttgatttctagaatgctatacttttttctaatcctgctttgcagaatctttagctaacctgatagaattgtgcttttctatccttggtattagatcaagcggtctaaacttcccagttagactttgaggtttttgtctgctcttgtgaacaatcatttacatacattgtgtgtgtgtgtgtctgcgcgtgtgaattcaggtacctagctctttcttaaatcaattcagacatgattcgtggctgttaaaacaagctacaataacacaaatgaagaattgttcaaatatcatgtgcgttaatgtccacgctcctgaaatagattacgtatgtttcactaggacttgttagaattgtgaaacttataaaactgttctttttgttaggcaatggtgaggctattttactttcaggtttaaaaaacctgttgaagcattagagtgttgatgaatatgagtttccctaaagtagatagtatcttcagtctgaagtatatatgcatgtgttgtttctgatcatagtgtgcatcaaatgggatggttctgaagatcttttgacaaactctttgtctatcaattgatgtttaaggttcaacagcgattcagtttcataaaaggtgatgtttttgcttttgcttttgttagcagatggtaccaaatcaaaaagcttaggatcatatcgagtgccccttatctgatagaggactcaaggaagcagatacttaacctcattaagcatcatgctcaatcttagctccttattgtgctactaaagttccagtctattggtatcctcttccaatcttattatttgtgttgtttttttgtgtgtcctgacgtttcacagtgtccattcttcatcatgtcattctccattcttcaacacatcacaattatattttagctaaatagataaaatttattcatatgatttattctaagagatattcgacatttttcaatataaattttagaaaccaaaaaattgtgtaactcgaaagggaaagttcatatattctttgtgaaccaaatcgaattctctaactgaatagtattttgtgttttcatgattttgaagagccaaatctacttgactactggttgaaaattgaaagaaaccctaataagggacaatgataacgaaagattgggtcctcaaacaatggacaccactattctactgccatttaaaaaaaaaagtttaatatttttgaattttattgttgttgttttctcatttcaaaacatccaaaattccaactaagataagataacttatttgcagtaagaaaaacggataattttatttatttgaatccatccatcaacataaaggtgtgcacaaaggacaatattaggcaaatgacaatgtcacgtaatctacgttgcccaattgaataatttgattatcataaaagttacacaagtttcattattgagtattgagtactgaatagagatatcttcaaccataatgtagctttcacaatttccatacgcgaaaaaaagatatacacaaatggagtgtgtagagtaaactaaactcactctattatgactaacagtcaataacacgtacgtagttatcaaattattaatgagtaaaaaagttccaagttaaattatgtataaattaatcatgtattagcattagattattaaagtgtgaaaaaatgattagattcagacaaccttgaaaataaggagttaaagtcaaagggcgactgcttcacgtaactttagacttacgtcattactaacgtcacctttctttgaaaacctcctccttttgaaaacctcctccttttggcaactttaataatagatccaattttcttggtttttccccccattatttggaaattataaccattttactacaagtgccttctaaattctacaacccaacaaaaaaaaaaaaattatattacatatcatacaaaatagctagataataagtagttgatgttattgttatgaaaaagttggtggcactaaaaacatgtgatggctaatgacccttagatatgtgtagataagcagactaatcatgcaaaaataaatacaaaattgtaaacatcgtaattgtctggacaataaatcataaaattaaaaacataaaaccatttccaaaataaaattgtgtatggaaaaaaatatatattaatctcacttactatataattcattacctccttaatctgcagaaaaatgtgtataattaaagaataaaatatttagagagcgctaattaaactgtaattactttttgagatttttttgggtcagagtcaaaggtcgccgccatctctctctgtgtatataagctatgttcatcttcttcactcaacaaccattctctcttctcttctttatctcaaactctttcttcttccaaatcataaacc

SEQ ID NO: 579 - DNA, 3000 bp, Arabidopsis thaliana
tgcggagcaagtgagtgacatatatatacatcaattattcaattaatctttagggttttgatctatataatgttcagatgttctgaatcgtttttgatgtatgacatattttggtttttttttttgttggattttggttgccaggattttctcaatatgttctttgggaaggtctttaaaccggtatctccggtatacaacctgattttgtctgtgctttggcgccatccggggaaggttgacttggagagtgtcaaagttgttcactactgtccacctgtaagtactttttcttaagctccaaagatgggaaattaattggaatataatatatggtatatgaccaaaaaaaaaaaaaaatggtatataatatatggtatatgacttttattctgctgagcatataaaattgttagttttgggggaaatttagtatctctattactataaaatctatatatatacatcaatataaattaattttattccaaattaaaccttctttaaacagaaattaaagtattgtcctatatgggaatgcatttacatgaggatagttctgccaatgctttctcttgcattttaacatctattgattattattggtgaaactaaaatgaaagggatccaagccatggaggtacacaggagaagaacctaacatggacagagaagacgtcaaaatgttaattaagaaatggtgggatatctacaatgacgagtctcttgattttaaaccgaaaagccctgcagatttggaagcaaccgttttggaatcaacaattatagcttcggtaaccgaagcaccactttcctactctcctgctgcaccttctgccgcttgagaaatcggaaacgcaagtaccacaagaatgtatgtttgaatcaagttggtgtgtttttgatatattctcattttttgtatttgtttggtgtggtgaattttgtttcgtttttgttaaattactatttgccaactgcaaagaaatacttatttcaaattacaaataatctatttgtatttatgcttatatgttcaatcttgtataataaagtaatgttttctttaaaagagttatgatttgacaatctgatgtttcaatttcttgcagtaactttacttaattaatttcttaaaaaattagacacgttactggtttcaacacattataggctactgcttcaattagtaactatgatttagaaaaagaatgagaaagaatatataatctaatgcttgaaatagactacaaattttaatatattttttaattttgttgtaagtctagattatacattaatgccgtctacctaactaaatcacatgaatatttaaattgttaatcattgtctgttttattcacactaaatattttcttcttcttcttatctctctttttttttttttttttttttctagtaacagtataagggagagatagtaatcataaaaaattgaatacaaagaaagaaaaaaataaacaataagagcaccctcaataggggtttctaaacaagtttcttaacaaataataaaaattttatatgatttaaatattacataagtctcttaaatttgatgaaacctaagtaaattgtctcttaattaagagataattggttttagtttcaccaaatttaagagacccataattaaaaataatatttatctatacttacactttaattttgtttaagagatttatgattagaaattaccactgaggatgctctaaggtgctgacacaatgcgcaagaatcaatagtgtcacattatgaaattcaagttttgttgttttgttgagttaaatttatcaaattcaaggttatgtgtgctaacaagcataactggattcattggaagatatgggggcaaaatgataacaaagaatgcttcatgtcattttgtaaacagtttgattgaaaaaaatggttaacaaagaatgcatgcatacaagaacgaaagagcttaaaacttgaaagtaggcaattatttaacaatggggggaggggaggcataaacaactcaaacacgattcgtgggtttaaccaacctaaccctaactcttaggcccacgattatgatttttatatttttgaactcagaaattgagtttttcccatatatactgtgaactagtccgtcacatgttatcatcaaatgccccgaccatcccaaccaatgttcttcgtgggcctatcaacaaggtcagaaacgcgagtgaatgtatggtttatgtcagtaactgttattacaagtggtcgacaaaacacttccatgtcttgaatacgacaagacgtaggagaagcacttccatatctcttaatacgacaaggttatcagcaatgcggtggaacttgatttgaagtcaatgaaagcatttactgctcatatttgattcgatttgttgaataggcgtagaattttccattcaattaaactacacaagtaaattttttatttttctttaaaagtctttttttgtttgtttaaacagaaaattagtagtacagaaaatgaaatatttttctatacaacgaaaacacctctaagttttatatatagatttgaaaaaagttgttattattattttattttttggcatcgaaattatttctattctgggagagcgtttgtatttcaaattctattttttttggtcaaaacaaaacacctttagattacttttcagtttcttacattttagtttaacgcacagaaaaaaaaaaaatactattttctatccaatccggagaagactaaatgacaggtcagcaaaattcgtctctctttctttttaaaagaaaaattattgacgcaatcaatacagccaaacatcgctccatgaagaagaaaaaacaacaacaacaagtcagccatggagaaagagagaagaagtagatagatggtttagatccaaagtagttgatcgttgaaatttatttctatttaacgttgaaaaaagagaattttgcaaaaacccaaacaaaaaacccgcc

SEQ ID NO: 580 - DNA, 3000 bp, Arabidopsis thaliana
gataaagtcgtttcattgtttgtagagttccgttgacgcaaaacgtgacgagaaaccgacaaaatgagacacctacataaccacgtggaatgatatatgccggaactataatgtaaagttcgaaatggagaacactaaaaagacaaaagataagctataaacctctaattaggtataagttaacacagtgcaacaacgtgaacatccatttggccaatcgacatattatgctctaaatttactaaaagagtgaattactcggtaactatacttattatgagaaattgattagttggttagtaaaaattaatatgaacatttacattacataacttttatatagattgagtgttttttttatcattatataatattttttatgtgaacatttcatttatcaaataaatgtgtataaaaccataaatctgatattctaaaaaaaaattttcttagtaaattagatatcaacataaaatataacatgttacagtaaaaaaaaaaaaagctattttgtgaaccctacaaaatcaaatatcactatccatagattttcattgcctttgggtcatttccctatctgttgtttacctttttgacgggtttctttttgcggagaagcataaaaggatttgatcgcatattcgcattaaaggctcaattggtagaaattgaagactaattttaaattgcaaacaaagagacccatgccacttgtgacttgccccacgtaggtccactatgttgtctcttttcatcacacaacactataagacaaattctcttataagacaacttgatccctaccatcacctaatgaatgatatatttttcaatattatgaagaaaaagaattatagagtattcataatcaattgggaatgattgaagtagattatgattcttatatatttcgggtgatttttcttacaaaaatacaattttcaacatgccatgcaaaacaattttttttttgctttttttttttttctcaaatcagattttattttataattgacattgcaaaaaagtccgaccaatttctaccaagaatttagttcgaaattggttagaccatttttgatcgaatcatgaattgctatgtttaataaattaactacccaagaaatgatatctaaatgactgattgatcgataatgggtagtaatttcatcttagacaaaataagcatagtatactatttcccccaatattatagttacctaattaatctcttaaacaactgattaatcgatttaagcgatcgacaaaatataacataaaattatgtttaatagattacaaatcctatatatacatcaagttaacgcctaatggttgttgtaaaacctttaactgtgttttttttttaattggtcagatttgttttagcatatttctttaaatcgcatttgagtggcggccaaagtttaacagattaaggaccctaattaagacctgacaacttcattctttgaaaacaacaaacccgtggtattacttaatcgctgtcaccgagtgcattacgaaccccatatgtccacatgcttctttcaaactaatacaaaactgaatacgatttccttcatcaataattgagtataataagatcttaaatactctaactacaattattaaaagaaaaggttaagtttttgccaatagcttccacgcaagtggttgaccaattcaacttaactttctcaaaacaatgagattccacctaaactatataaatgacgtaggaattatatgtattacactaatataacaactcttatatattagttcatctctcttattctcgcaaagttttatttatttatatttaatatttaataataaattaagttttgaatgctatttgtgaatttttttaaatgaggagctatttttggaagatttttttttttggagctatttatgtcaatctcccaaaattaaaatttacagattttatgcttattgtttttgatgttaatttggtataatatattttccttaaaatagaccattacctcaacaaatatttattgtaactaatcctatatatatatatgcaatataatataatatcatattatttaatgtttatatataataaattaaaattccattgattttatgtttacatatttttataaaatttaatatagttaaacttaaattagtttatctatattcgtaactaataaaccaatgtcaatttttatatcagcaatgaagaattaatttatgatttatttttttaaccaaaaaaaaaaaacaataaataaggatcatgacctatcaagatctggaaaatctttcaactgttacatatatgaatatatgatagacaaaccataaacatatcaacatcaaataattaacgtcattagctgtttactatattaatcacacaattataaataaaggtaactaactaaagtatctaaaatggaaagaacattttgttgaccacataataaaaacaaaacaaaaaaatagagacaaaggggttttacgtcatttcaattcctgacgaaaaaaatctttaacacagaggggtaaaactgtcatttggatatcggctcccactataaaaagcctatttgcttcgtgttttttggtcaccaaacccttcatcttcttcgtttcagcttttttttctctcatgtttctcgtcttcttctaaacttttgtgaccacccaaaaaaaaaaacgtaacggaacaaaaaaaaaaatgctccgatcacggaattgtaagatctccgccgcgaacgaagccgttatttctaatcgtctttcaatttctaatctcaaagttttattcgtttttgaatcctcgccattgaataatttgattaatcgtttttccgataagcttcgtcgttgaacttatctccgatctctgcaaattttctctcaaatctctccgatcttcctaattgattagaaacttctccatcgtttgctcaattatttcggatttttctctgtttctttccaacaaaatcttca

SEQ ID NO: 581 - DNA, 3000 bp, Arabidopsis thaliana
actaaaaattaagggaacttgtctttgatattttatttactagttatatatagtccttaccgaacctcgtcggcaacatcatcagtgcgatcaagaatcgatcaccattaaaatgctttattgagcacgatcagtgttcaccatgtaagaagattattgtctcacaattcaaatcaaacctagcctaggcaacaaaaattaaatttctttaaacaatagaacaaaactcgtccgccccaaccatcctcttcacaacattccttaatcttacaatatctatataactaacgcatcatttggatttcactatgtaactaagtcgaactggtgtgaaataattataaatttaaataaataaaaaggtgaaaatatggttgtacacgaaggtatgtgaaataattatgaataactaaaatgtactgaattatttattttattttaatagcaatggaatctaaattaaatcaggatataatgaaaattttgtaaaattgtgattaaattgtcattccaaagaaatcagagaactgtctttaaaaatttggaagcgagtttaatgatatagcctatatgaatggtacagtgtgaatgtctctgagaaaaattacaattccacatttttattacagactagatgagaaaaaaacattgatgagtaggtcaaattaaaaaactatattcacgttttcggtgatacattggaaaaccatataaaacgatcatttttcaaaggaagaatagaaactttatttacatatttaattattatggaagatgaaggaagaactttatcatagactacgaaatcggtgtggctaatgaaatacagacaccttatatattacatattaaatgtacatttcaatctggtggatagttccaaactaatcttcttcatcaaatattgttggcattaatgatctcactatggaacacgaaaattcagcaatgttcatttttagttaagaaacaaatcctcttacgaactctgtaagatcttgaaggatcaaaagcctttgatctcaatttctgtatagtttttattagcctagtgctttatatatgtttgatacttctgtttggcaatatcaatcatagtagaaaagatatggacttcatttgaggtttttggtggattgtgtctatatgtgaaatcatgggatctcaagatttgtctgcattcagtttccaagtcaaacatcgtaactactgtttgattttccctcatgcttgcagttttcatggatatctcaagatttgtcttcttgcactttccaagtcaaacataaagtaactactgattgatattccctcgtgtattaccctctttcaaatgacacaattgggcccaagtagaggaatttcatagtgaattcaaaagattaactgtattccaccgtcgtattttgataacatttagttattccttttcttttttttcttctgcaacagtttttttttaatacatttagtgttggtttggttcaatgaaatattatatgttacttctttttttggaaataaattattcattctttctactataaaaggaattgttcatgcttttttgatacaatagtataccatttcaaaagataccatagaccagttattacatgaatcgccaaaacaacactaaaatcagaaaatcagtatattttggtatagtctccaacatacaatcataaaacctctgtgaaatttaaaatctatatttgacatttcaaagtttaacaacatagttctaaataattacctaaattttaagtcaaatgtgaattatattttactcttcgatatcggttgttgacgattaaccatgcaaaaaagaaacattaattgcgaatgtaaataacaaaacatgtaactcttgtagatatacatgtatcgacatttaaacccgaatatatatgtatacctataatttctctgattttcacgctacctgccacgtacatgggtgataggtccaaactcacaagtaaaagtttacgtacagtgaattcgtctttttgggtataaacgtacatttaatttacacgtaagaaaggattaccaattctttcatttatggtaccagacagagttaaggcaaacaagagaaacatatagagttttgatatgttttcttggataaatattaaattgatgcaatatttagggatggacacaaggtaatatatgccttttaaggtatatgtgctatatgaatcgtttcgcatgggtactaaaattatttgtccttactttatataaacaaattccaacaaaatcaagtttttgctaaaactagtttatttgcgggttatttaattacctatcatattacttgtaatatcattcgtatgttaacgggtaaaccaaaccaaaccggatattgaactattaaaaatcttgtaaatttgacacaaactaatgaatatctaaattatgttactgctatgataacgaccatttttgtttttgagaaccataatataaattacaggtacgtgacaagtactaagtatttatatccacctttagtcacagtaccaatattgcgcctaccgggcaacgtgaacgtgatcatcaaatcaaagtagttaccaaacgctttgatctcgataaaactaaaagctgacacgtcttgctgtttcttaatttatttctcttacaacgacaattttgagaaatatgaaatttttatatcgaaagggaacagtccttatcatttgctcccatcacttgcttttgtctagttacaactggaaatcgaagagaagtattacaaaaacatttttctcgtcatttataaaaaaatgacaaaaaattaaatagagagcaaagcaagagcgttgggtgacgttggtctcttcattaactcctctcatctaccccttcctctgttcgcctttatatccttcaccttccctctctcatcttcattaactcatcttcaaaaataccctaatcacattttgtaacaataatacaattatacattaaaactctccgacg

SEQ ID NO: 582 - DNA, 3000 bp, Arabidopsis thaliana
gtttttaagtcatccgatccctttcataaatatcagcaagttttgacgtatgacaattttttattgttcatgtaattacaaacaattaaagtgggatcgttttaccaaattttgtttttactaaaacgtgtatgctgacagaaaatctgtcaatgtaatacttgtattcgaataattaaactactaaaacgtgtacattgaaagagaatatgttttactttcatgctggtatccaataatctctatggtaattggtcggtaattttagtaagtttttaacgtgtggaactaatttaacatttcttcctttggttttagaagtaaagcatgaattataagttaaagatataggcgttttgcgactcaacaagtaatcacccactcacagcattagtaacaaactctgagattcttctctataaatatcacttgtgtgtgttcaagttaaagaagaagaaaatggagaataagaaagaaaagaaaagaaaaagaaaaatggagaattcaagttccgaaacacttcatgttgaagatttacaaacggagataatgtcatggctgcctctgaaaagcttgttgagattcgtcatcgtctcaaagaaatgggcatctattatccgtggagaacaattcaaagctctttacttgcgtcgatcgatgacaaggcctcggctgatgttcatggtccgacgaattgcaaccctaccacccgaacctgagatggtgtggtttcagtctttttgtaaagaggaaagatgtattcccggccaactcgaagttgagttcttgtttcactctgtttatcaagaaaagataccgtatttttcatctggtcaacagcagttgcgtgttcctcctaatacaaactatacgtctgtttctcaacccatcggaggtttgatctgtcttcagtcagaaactaagtttgcgctttgcaatccgggtacgaaaaagtctcgggctttacctgatatccaagcacatgaaaaagcttttataacaagttttttaggatacgatgaagctacgaacgtattcaaggtgttatgtttgacgatggtatgggcccatgaaccatcaaaacgagtttatgagtatcaagtcttgacggtggaatccggtgtagagtcttgttcttggagagggatcacatgtaaggagaaggatcacacaccagaaactcaaggactatgtaaaggaggggttttgtactatggagctcggtccactagtgaccatcgacctctggtaatgagctttaatgtgaggtctcaagagtttaccgccattgaacttcctgatcaactacatattagttatttttggaattttgtgatttacaatggggatattgccttagtgaacgaatctgactttgaccctagagttgtgaatgaaccgaatgggaataaagtttttcacatatgggttagggatgcaactgcacaagaatggcagagaacccgcatcgagattcctcgttgggaacaaaatgttggacatgtggactatgttttcagaggtaccactggaacaaaagaacttgttttcgcccaagactctcgccattgcgaagatgatttctttgtgttgtattacgatacattcacaaaagatctcagaagatttcagattggagtgactggccctaaaatttctgttcgaacctgcttggatcatgttgatagcctttggcttatgtgaagaccaagatctcagtctctcttcttgatttatgctaaatattaatgttgtctctatagtagtaatatcttattttagttttcatttcattaatctttatttatgctaaataataatgttgtttctcaagtagtgctatcttattgccattgggatggtttgttttcatttctactgtcgtttatctttatttatgctaaaataataatatgtttgttctattcagattataacttcaataacatttctaatttctatatatatatactcactatttctcaagctctgagagccttttcatgaaaccaagggggttccattccaaaaataaaaaagaattgagtacagaacaacgttgtaagatatgcaagaataaagcatggaagcaaatattagccagaaagatcaacccagagtcgagatgaaaaaaatgttccaagtaagaaatcaaacattcatatataatacttgttcagataatcaatagaaacaatggtaagaaaaagtaccatataaagtctctcaatcttcgctataacagagttaagacgattaggatgaggtttaattcaccatttcattctctgtttgtgccccctgcatttgatatatagcaaaatcattagacaatgataaatatccacattgaaatcactatacagctttagttttgtttcagtttcaagagttagtttattgaaaccctagctccaaactcaatgtcaagaaataaattttccaatttcagctctcggaatgatacaatacaaaaattgttctaacagagacagagaaatgaatacgtgagaatatgcatgtagcagctaagaactcaccgcaccggtgcaaggcgaaactcgaggttaggaagccgaaacgaacaagccgccgttttccttgctagcctcatccataagcttcttccatgatacgagcgtggtggtctcctattggagaagttcgactttaagtactttccgatcaccggcagtcaatatctctgacgagattttacacgattcgccgaaagttggaccgtcatcggttgggaccgggtcagagttagactctgtagagacccgaatcggagaggaagtgaaggcccatgaataagcccatacaattacaattccaaggaaaagaagtatacaaagacacgttttggagctgcgtaaactgtccccataatcctttgccatcaacaacttcgattccggggactacaagcctctgtcttctctctcgtttagggttttattccaaaattccgtgcttcgatcccgaagatcagaaaaa

SEQ ID NO: 583 - DNA, 3000 bp, Arabidopsis thaliana
catacacgcttctgtgaagcaaattgttgattccagcttcagattgttgcagggttctgtttccttatacggtaataagaagactctatgttcttctgcttattgatttaagaagattacttcaactgtgtatatgaatttttctggtggttctgttatttggaaacagagggatcatatgagaaaggaaggaagcccacgattccgcagcttgcaggagcagtgtgggaagcatgttctaatttaaagaacgtgcctgaaacaaacatcaaagcgattggaagagcgatggcacatgtagctgtttctatgaaggatgtgcttagggagatgaaagaactgaagcctgcttcttcttcacctgatcataatgtttcgacaaactcggatgacgatgatttaggcgatgaactgtctcctgaagaatttgaagttgctaaaatggtagcagatattgtgtctgagacgctcgttgttataaaagagcttatccgtgctatcacatgcatgatcaagctggagaatccaaaggataatagtgagtttgtggattcgtttgagaagttactgaagttgtgtcaaggaattggtgtacagattgatgagcttggagcttgtgtttacccgccgcaagagtttggtctcatgaaacaaacagtggagaacatgagggaaagtattggtgagattgagtctgatgttaagagttccaagaattcttcatcagaagctttatcaggatcatgcagaaggctgcagagtttgattgaacatatggtaaccgagttggacacaagaatcgaagctgaagtagtttacaaaatgcagaatgttactctttagcactgagaaaagtttgaacttaaggttcttacttcttaacttctagtgtttcaggatatgtttttagtgtgaaacagttcatcttgaaatactaaatcctatttgatattgcaataacaaaacatttgtgagaggagagattcaaagaaacagatcttgaagaatatgaaaatgtgaaaggttgttcctacaatgcatgaatcagcttaagagcaaaccagagagaatacgaaggaattgataaactattctatagagcagcgaaatcaatgtcaagaaagaagctctgtcttcaatgcacttgaagtatctccacagacaggatacaaatggattcgatcagaccatgcattcctgcctcttgaatcgatctcggagatgcatttccagacagcactgttagccttaaagccacttccaaacccaatctgccatactttatctcccattttcattctaccttttgcttccaggtattgcagctcataccacaacgaagacgaagatgtgttcccataacgatatagagttgaccttgaagcttctacgtcttccttgtccagcttcagatgcttctccacgccttcaattatcgcccttcctccggcatgtatacagaaatgctcaaaagctttcttgaagtttggtgtgtatatctccttgtgcattccccattttctttggatgaatgagattatgtatttgagctgctctgaataaggtagcactcgagggcctaactgcaccacgttgatctttaaggcctttgatgctaccctcacaagctgcttggacaatgctactcccacttttccttcttcatcaacttgctgcattacactctcgtacgattcagtgtctgaaccaacatgagttctgataatatgctggagtttgtatttcgccttatgcgaatcttgcttcctattggaaagaagaatcgcagccccacccattctgaagatagtgttggcaatgagcatcgacttacacttccctctgtaaccatttggactaacagcttccatactcaacactagggccaaagaatcaccatgaatcttcataagatcttttacgagattaaccgaaagaatcccggcgctgcagcccataccgctcaaactgaagctctttatgtcactcctcatgccaaacttgttaatgatcatagaagttatggatggagaaggacagaataggctgcagttagacacaaggatgtcaatactctttggatctatctcatgctttgagaaaagatcttggacaatagcgaagaggatctcatgagtttcttctctagctgcagagatagaagcgtttggtggaatctcatggactgtcgcaggcacgctcgcgtcatcactaatccctgatcgctctaaaatcttctgctggagatcaagactttcttgatcaaaaacaccggaaatggtaagatgctcaatgaaattagagaccggagctcgcaagaagtcaggaggttgataacatgagaagtcaatgaggtatataatacatcttggtttgaagaaatagtaaccaaagacagctatgagaacacaggctgatgctaccaggaattggtgaaaagtgataaaggtctgagtgataaggagagcttcattgatgaaatgaaagctcgattccatattctagaaaccaaactgggaaaagagagaagcaagatgatcaagagttttgtttttgtggcatatgttggttatagtgtttagcataaaggaagtgaaaaacgaagtttgttgcatcacaaggtaagcatgtgaaaggtgtccaaaacaaggatgaaattcaggtctcgtgacctatatgagaatttgcatgcatgatttcatgggaaatgaacattacgtgtctgttgagtaacttatggtctctgttgctaatctctacctctatctcaccaactccatgtagtggaaagattgttgcatctttcaagcataatgctagcttgagagaagtgagaactttgactttgtaattggagacgaagaccagattaatacaatatgttaataaaataaaataactaaaatcaaaaaaaagaaaaagtcggtagggcaatatcgtctttttccgatcgtggtcgtttcttacaagtttcttcgttcgttctctagaaacgcagaa

SEQ ID NO: 584 - DNA, 3000 bp, Arabidopsis thaliana
gaacatttgcagagtgtatgtacttaaggcctctcaaaatttggtaaaggaagtactggagacaacaaaaaagtatatcaaacaatgctaaatgttaggaaacattatgtaaaagctctaattaggaatgtgtccactgatcatcacctgacaatggtcatcagttagagtttgagtggatctaatgatctggtgcaaatctgtatccatcaactcataaacaatatatacatcttcgaacctttctttctctggtagctcaattatatctttaattttgataacctgtgtagcaatatgaacgtaataagccaactatatgagtgttcatcaaagtgaagaagaagagattacattgtcatgatccatgtgggaaaggagcttgatctctcggagagttcttttagcatcaactctgttgtcaaacgcgtttgctatcttctttatagcaacctcttcatttgtctctgagtttgtagcacagctgtaatcataaaaaaggatttgagattaagattgtattcaagaatggtatgtttttttattgaaagtgataaagacttaccagacaataccataagcacctcggccgatgggttcaataggagggatgtattttgaagatagctcgaaaatgttaccgagtacattgtacataacatatctaccatcatatgtcaagatccctccatcttcccttttctccatctcttctttggaagaagaactcggatcaagacaggttttaagattaaaaaaggaagcaagttttaaaagactgtttctcaagtagctgttgttgccgttaaaaaggcaaagcagtgagtaagaggagagaaaatggtggcaccttttgcttttggtgggccaaatgaagacaaacttttttatttgatccgttgaacttcgaaatttgaatgagaattattattacaaggttaaaacttgacttctgcatcattaaagaaaaattcaaaagaaacaaaagagaagtatactatagaaaaagctatctcattgtggatcaataggtccctaggaaccaatagtaagtaaaaagcaaagtggtaaacatacaaaagcgagattattctcaagtctcatttcaatgtcaaaactctctcttgtgtgctaagtaaacagaacctgtgtgaaagtaaaacacctctgaactcattttcactatctcacaaacctgcattatcgatccaattctcccatcttatatcttcttacatattaaggatcagagaaggtgatcaaacctgataattatgtagatgtagctgaagctaagatataaggctcaggaaccacaaaaacatatcactgaatatttcaaattagcttcagcattttatgagtcaaaatactaagaaacaatgcaaattctctcatgaaaaggctctcacattgcttttgcattctccgcaattatgatccaaaccttaaccaaaaacaactaccctataagagtataagaccatgtctgcagaaatcagtagtaacacaagaatttcatgagatattaaagaagaagaaaagtaggccacacaatagaattgaggaatcaagaaaacagatacatacacttgggaaggaccagcacagcagacgtctgttactactaactaactcagacttgtcattgaactatattatatacggctcacttgttttgctgcagtaactggcttatcttcttttctggcttgcgttaataacatgagtagagagaaaacacgacttccgtcgagtagattcctatcaaacaacaccggttctcgaatctttcgacaagccaagcaaaagtaggtgggcatgaaaatttgttccccatgaaacagaggacattcgttgttacctattctaataaccgattcaaaattccgaatcgcagacttaataaatgtggacaattaaccaaaccgtgcattgctaggtctaaaccgcattggtttatgacccaccaatcaaggagcgatgggtgagaaacctaataacactgctgctgtgactttatcatatccttagtccaattgggatcttcgtctgcgtgagacgcgttcacacctgcgacagatgaaatcacggaaataccactgcccaacgtgttcgcaataaaagtcctctgatgcctaatttcgtcaatttactgaagaaaattcaacatcaacgccctttttgataatttccccaaagttagtgggccctccacacgaagcatgtatcctccaattgcatattgccaattatttcctaataatattgaaggattattcttttcccatctatataccaccaaccctaagatccgaacgtccattttaaagccgtgcgtttaatcatgatcgtcaattatattggcaaatttgaccacacgatatccgtcatctaacggcatctacagatctaccagaacgttctcattcatgactctatatatttcgcatttcttctcctcaacgctctcataaaaagtagtactcgtgtcttactcgtgccagccactcgcatttctccagattttattatccttcctcgaaacaaggtatgacggaaactctctctctccctctctgatccgtcgttgctgcttccattttcatcttgactcgatcggatcattgttatgcttggcttgatctgtgcttaatgatgtgtttttcgtagtagatccacgattcgttgctgcgatcggcgttattatcgtcagctctctcgtttctgttctgtggttcgatattgctgagtttctaggctaatcttacgaatctgtgaaagtttttgagagatttggcttctgtagctcactcctgcttgatttaggttttttttttttccactcgtatgaagctgttttagaggctgttgttgtttatgattctcagcttgttatgtatagttggatttcgtgagttttggatttgatctgtgcgtttatttagtagtgaggctcatgtatatatatctgtgtatttgttccagagcttagctaag

SEQ ID NO: 585 - DNA, 3000 bp, Arabidopsis thaliana
agcaaattttcactctttaacgctccatttcgtacattactttgatcatttttctttttatctatttttttcgtcgaccgttttctttgacgatgtttgttatatgattctaaaagcatccacaatggtagactcttagcaaaactcttaacaaatatttaaaaaattatataatttaaatattagataaatctcttaaatttggtaaaacttaggtcaattgtctcttagttaagagacaaatagtcgggttttattaggcccactagttcgttaaaggctaaagcagtgcccggttcttatagcggaggtaactttaaatattgggcccttactgaaaggtaaattagttgggtttattgggctttattataaggcccactaattcagcagtaaccctaacgaaaccctagcatatattagttcttaaacttcagctgagagaaaaccctaatttctcaaagagtctaaagagacggagagtgagagaagagagaaacatttcgagacaaatggccgccgccgctgctcgtcctctcgtcaccatccaaaccttggatggtgacatgtccaccgatcaatcctccaccgtcgtacttcccgacgtcatgacggcgccagttcgaccagacatcgttaacttcgttcacgcccaaatctccaacaacagccgtcagccatacgccgtatcgaagaaggccggtcaccagacctccgccgagtcctggggaaccggacgtgccgtgtctcgtatccctcgtgttcccggtggtggtactcaccgtgctggtcaagctgcgttcggtaacatgtgtcgtggtggtcgtatgttcgctccaaccaagatctggcgccgctggcaccgtcgtgtcaatgtcaacatgaagcgtcacgcaatcgtctcagctatcgctgcaactgctgttcctgcgcttgtgatggctcgtggtcacaagatcgagaatgttcctgagatgcctcttgttgtgagtgactccgccgaagctgtggagaagacctcagctgcgatcaaggttttgaaacagatcggtgcttatgatgatgctgagaaggcaaagaacagcattggaatccgtcctggtaaaggtaaaatgaggaaccgtcgttacatttctaggaaaggtcctctggtggtttatggaactgaaggatctaagatagttaaggcgtttagaaaccttcctggtgttgagctttgtcatgtggagaggcttaatttgttgaagcttgctcctggtggtcaccttggtcggtttgtgatctggaccaagtctgcctttgagaagcttgagtctatctatggttcgtttgagaagccatcagagaagaagaaggggtatgtgcttcctcgtgcaaagatggtgaatgctgatcttgccaggattatcaattcagatgagattcagagtgttgtgaatccgatcaagaaggatgcgaagagggctgttcttaagaagaatccattgaagaatctcaatgtgatgttgaagttgaatccttatgctaagaccgcgaagaggatgtcactgttagctgaagcacagagagttaaggctaagaaggagaagctcgccaagaagaggaaaaccgttaccaaggtaatctcaatacttgacttgttctcttatcaaccgtttttggattgtctttgtttagttactgattacattttgatctgtggttgcatttcatttgacttaacttatattgcaattgttctaattgactgagtttgtgtatgttaagctatacaataatctgttcccctctggtttagtctatgactatagtagtctttctttactagatcttaccttttctgttctgaattgtggtctagtagtttgtcttgtaaatctgttgtgtacgattctttgtcttgatattgattttaggttgagctattaagcaattgaatctcttagcactttcttgtcccttgtgaaaattgttcttcatatgtcctcttttctaactccactttgaaatatctatttttcttacatcaggaggaggcgttggcaatcaaagcagcaggcaagtcgtggtacaagactatgatctccgacagtgattacaccgagtttgataacttcaccaaatggctcggtgctagccagtaataatctcgtctgctttggaacactttccatattttagtcaaaagattttggtttttttaatctgttttgtctttgggtgtctggatatcaagttgaattatgaacaagtttcacttttttacatctccatttcttacttcgcctttatcagtttcatttatttatctcttgctccttcgtttcctatgatgatgcttgttatgttatgaacctacttaaaaacaagctgaagctttctttggtttaccccagcagaaacattaatcaagttcaattgatcaatatgtcgattgatttactgtttaaaggcatagtgtgtctatcaacccttaagtctttttggtggatagtgaagctcaaacccaattcaaatgtcgatcaaccctaacgtttttgtgctcgatagtaaagcatgagtataaaaagaacgtcgcttcttcctacaatcacacagatcatttgaagctttgattagttggtacaacatactcgaggaatacagaatgacacgtggtgtgtatctgttggataaatttgtattattcttctttactatggatggtttctggaaggcgcgccaagagtccttctttttccatctacaaatcatgaccgtccatctccaaaagaagactgaaacagtgaaactagaagcttcattttgatcatcagccagttttataaattgatccgtatactaaagtaacaactactagcactttcttctgtgatcgatcattgtgtttaaactaaaggtttgtatgttcttgtaatcttattgatctcgataggttctccattctctttaggttttaaagccttcaacgatttccagaaggaagcgaatttgaaaaaa

SEQ ID NO: 586 - DNA, 3000 bp, Arabidopsis thaliana
tggttaatatatgtttcatgtaaataaataaagaacaaaaaaagcattatttaaactaattagataaattcagataagattctacgattatgaaaatgcgaaaagcagatataaataattcgatgccaattttgaatttatagatcactacactcatgcattcttgttatgttaagttgcattactccaaaactaccaatatcttctggagtaaccaaatagaaggagggaattttaaaacaagctatattcacacagcctcggatgtggtgcctgaacatattggattggttttgataatatttcaattattttcaattcaaataataataataaaactgaaaataataaaatccagtttcattgaatatttgggtattcctagtactaaattagttaaatcaataaaaatatatttgaaaattttaaatccgaaaatttaaaaggtaaaaaaattattttatttacttaaaaaccttgcaaacgaaaatattttgtatataaaaaaaatagtttacataataaaaatatttgcaaaaaacaatataatttagtcttagtgttaaatttacttgagtgaaaaacagttaaactttatatacctcaattagataagctattaaatctatacctcaatttttttattttattttttggttcaacgctatatcctacctaattagattggctaaattgtataagctagtgcaaaaagttcatataagaacaaaaaactgtaaaaggaaagaaatctacaatttcatgtaaaaaatccaacttattaattaacaaattttgaaaaggaaataaagtaaataataatggttatggattcaccttatctaattataaatacatctttatatgctctatcctctatgagtgtactatagagagtagagagagtagaaaaaatgggttcctccatattattggttttgtttactctcatggttatgctgtccatttcttatgaaccactcaaatgtaattatcttgaattttttttgtttgcttttcttcttgtgctatggttttgaatattcataattgcgttgtagggatgggcataaacgcgagccatgtaccggaaacttgctaccatcattgtaaccagacgttcgagagtagtcgccaatgctttaaatggtgtcaagaattagctcgtaaagatggtaatcatactcatttatatactaattaatgggatggaataaagaagttttgatgggtttcttaattctcctccttcttcatcgtattacatgatgaaatatgtaaaattgcagagtacaagatttatgggtacccttactcaaccaacacaaggcgtgtcctcgccgttcttcatgagaaaggtctctcttacgatcccatcaccgtcaacttgatagccggtgaccagaagaagccgagttttctcgctatcaatgtacttttcacatctaaatatctaactctgcttcatgattaatggttaggtcttaactagggtttccattttattggtctcttcttattgatgcagccatttggtcaagtcccagttttcctagacgggggtcttaagttgactggtgagtttaaaactacattttcaactaattaatgatctaatgaattttgatataatttgttttcgtcagaatctcgagctatatctgaatacatagcgactgtccataaatcaagaggcacacaacttctgaattacaaaagctacaaaacaatgggaacacaaagaatgtggatggctatcgaatcttttgagtttgatccactcacatcaacactgacctgggaacaatccatcaagcctatgtacggtctaaagacggactataaggttgtgaatgaaaccgaggcgaagctagagaaggttctagatatatacgaagaacgactcaaaaattctagcttcttggctagtaacagcttcacaatggctgatctttatcaccttcctaatatacaataccttatggacacacatacaaagagaatgtttgtaaaccggccaagcgtgcgccggtgggtggctgagatcacagctagaccggcttggaagagggcatgtgatgtgaaggcttggtaccataagaagaagaattaatcttataatcttgtgatgtactttcggtgatttctttaagtttgatgttatgaataaaaggcaaagcttttgcaaaaatcactcttttttttgccataatgatttcaaaattccaaagaataatatatacttcaatatacatgtcacaagattaaatgtcaaagttgtttataatgagcatttttgtggatgtggaaaatgtgaaaattactctgttcctttgaatgtttctatacgaaattatagttaggatttagtaatgtatttctccataattatgctaaatttagttagttacttcaatatgattaaatactttattgaccccaaatttgtaattgtaccagattgtcaaaagtgtgaaaccaaattttcttttcttttgatattgttttgtttcttattatctctcgttctatcgaatgatctaactcgagcatccaacgatctaactcgagcatctaacgatccacgtggacccaacaacgtcggtcagagtttgactagtagatgaaggactattcttgtggtcgttgtcacgcggtggctgatattttctcttatttttattttattttaactattttttacgttatatttaagtcttgaaccaatagaaacgacgaatcatacattactcagcttgactttgaaataatcctataacaaaagagcattccaagaattttatccaaaaaacaaaataaaaaagagtattcaagcttggtggcgccgtttgtttttggtttattcactaaagttactctgttttagttgtataaatacacactcccatttgtgtatttcttttcatcaatcacaaagatctctctacttcaataaatctccaccttactttaagaacaagaaaaacacagtattaacaa

SEQ ID NO: 587 - DNA, 3000 bp, Arabidopsis thaliana
atacctcttgatagctccatatccatggcttcccacaacaagaatagaagcatgatgcttatctacaacttcacataggatattccttgcatcaccttcgaaaacttcgatcaccgcgccatgaacctacacaacaaacctaggaatgatgattgaaaagaagaagatagttgctaaccaaagatagatagttactataagaaaaaccagtgctacttagcttgaagctcttaaatgtgctagagattcacattcacattaccaaactcatctaatagagtccaatacaacacatgatgacgattataaaatccaagaaacacataaaacgaatttgaatgtttgataatagcaagatcgtaccgatctgctctgacaaattgctttggctttctcgacaaccttagcagcggtatgcttcagatcagcatcaacataaggtacaacctccgcagttcctaaaacacacagattaacaaaacctaaatgatctctccccatcgctgcccaaaacagaacccctagaagagtagattcgagagtgaaagcaaagagcgtaccgggaccagcgagaccaacggcggagacggcgttaggtttggcgtggacgatgaagagcttaaaaggataattgggagcgtaaggagcgaagaaacgatcgagcgtccactccaaggcgtaagtgctctgctcgctgtcgtcaactccgacgaccatcaccgatttcccatctccggtggccatgactctgacgttgttcgccggcgtgaagaaaacgcgctcttgtgtttgtggtagaaagaagcctagaagaatcctccaaagtgtttgcacagaaaaagagagttttggtatcttcttcttctattatttaatttctttaaataaaaagaaaagaggaatgtgatactttgatttgatgacgtggctggtcctcatttctttatgcctttccattagtaaatttcccaatatttaaagttacccacagattttaaataagaagaacccacagattttacacaaaatttattctaatttgaatattacccataaaacaaagtacataaaaggattttgcaggttaacagttattagctttttagtaacaaactgatatgaattggtttgataactttcgattttacttggaaattaactattacaagaaaaatctaatttcaaatagtggaatgatttgagttgggtaaaatccggctcagatgataacaattacaaaataaaaatgagacggccggctgtagaataatatgacgacgtgaagcaaaagcaggagtgcgacagaaacctctctaaccaaattgcttttagttatattcttcttcgtcttgacgctactctttacctttttttatctgatttcagatttctccagaatcttcagattcccatggccactgttcatgttgtcggtctgaaaatcaattctggatctccagggaaggacacatcccgaaaggcacctgatgcaattcatgctgctttatcaccgtcatcatctctatcattactcagaggtacatataccttaaaccccaaaccagtttctccgtagcattttgagacgtcatcattcttatctatcatcaaaccttgctctttgtccatataggagtgttaccaaagtatttcagctcagagttgtcagtggctcagttccggttggtcgaaggatcttaatacatagtggcatttggacatgagaagaacacagattcttgggatggatgggaggtaagagaaccataccctaaccttaataatgtcctacaagtcggatcagcagctttgtttgatttttgggtgttttgcagcttctacaaaggccagttttgatccagtacacggaggagagatgtctcagctcgagtatcataactgtctgaagccgccttctgtgttttgaaacaacaagtcagcattctcttacttcctttatatatattaatcttgttgagattctggattttaggcttgtgtctttggtaacatatgtggtttccggttagttatggaattgtcggtcaatctcgaggcaagaagagagagtatgtatatatgtaaatgttgaaccactaatcacttaatgattatttagttaattacgttggatctcatattgagaatactattttgcatatatatttttctgaaaaaaacaacaaaaagaaaggtcaacattacaagagtaaaattgcatatgaagagagtgataatgaaagttcaagtgtttgtttctgaattcttgacatgtatataatcaccatataactgtttccaaattgtagatggtaatgcaaaaatctgatgaggagggagatggttctgtttccagcaactagatttagttataacataaggggattgattattgttattgttattgatccttcttctcctgttgaattggattgagagttagttggtcaaaaggtgttatgggttttagaaaattaataaaaacaggtgggctttgtctgtacatgtccttaaattatttgttttgggagtagtttaatatcgaatgatacgtttacacgtaaaaagtcttttcttttgagtcgtcgtctcaggaaagatgagattcgtttctaggagaggttgactttttcaatccacacttataactctagaatcttatgtcattgatgacgacctcctctacacttttggatttgtatgtttacaaaggaaggaaggattaccttagaacagtttatgtgatgtttgtgtctttctatttttattcaatgaaatttctttacatgtacatagattagctatattgacatgaatctaactgatttttttgtttgcaaaataacaaattagtgaggggaattttgtttcagtcaataaatccgtgatttctatatgttagatggataacaatgcaataaataaaggggacccaataaaaaaaaaggaaagagagacgtgcctgtgggtagtgggtggtggtgagaagattctggaaaa

SEQ ID NO: 588 - DNA, 3000 bp, Arabidopsis thaliana
gaaatctgagttttggatatcggattgaagattaagccagagtttattgagctttgatatgtttccatggatgtctccgacgcagatcacagttcgtggtttttgggtcatcattagtcttgtttcttgcaatgcaatcaataattctaagcattatttgattcgatgatgtttgatagttttgtcaacaaaagtcaactgtttcaatggttatgattacataaggtacttcatcgcaaccgtcgaaatcttcgcgtgtaaacatttcagatcgtacggtcaaattcctatgtactcaatgacttttcttcattatttcataagaaaaaaaagactaattattattcacattactattacagcatcatacaattcttcaattctctcaatcgctcttcttgattctctcgtgtaattattattctgtaattgctctttttgacataaacatgttttggatattgttgtgttgtgtggagtataaaacggattaattttcttatagcggaaaaaactgggatgatgatattagctggctttttaactgtaataagatatcaattaatttgtactttcgtagtgcatgtggtaattaacataaagttttaggaggaatcaattaatccatggcaacatgtggtaattaaaccaactccattttaaaaattcttataaactacaatttatataagtcaatttcctgacaccggaagtatttttaaatattttatctcaaatttttattacttatttcgatggtggttcaaagaatatatacttgcccagagcatagcatgtggaaaacattggactgacttttgaggcataacttttttttttaaaacgccaacagaaatttttcttcatgatatattgatatgcttactagtttcttcacgtccctaattcattaattctcttacgttttctggtttgtgtaaataatatacattctttttctttgggcaaaaatataatattcattcttaaacggaaagtaacatggtataattgaatgagacggtgacgtatatacagccagactgcagtaataatattcgtgaatcgtgattataaattcataattacgtacatctccttcttaattaacttactcacgcaattccattcatggctaaaataatgtgctcttcaccaaacgttactaacttaccaattttatacacacatcatcttttcttttgataaaagctcttcccctttgtggtattgttcttaattacgataaatatcttcaatgattaaaacccaattcattccccttgttgcttctttaatcgaactcatgaggtggcttatataaatggtataattaatgtggattaaaattgtaccctttaattcatgtaatgtgtcatttccgtttcttcacgtaatctcaccgtaatctctatatataagcacacaagcaacacaatcgatcataaaccaaaaaaaacgagagagagagatggggaaggggggttggcttcttaactttctgaaccatgccaaaaatcaagaaagtgtggagaatcttgacaaaaacggtgccgtaaaggccccaagcagtgggtttaagatgccgttgcattacccaagatacacaaaggaggattatgaagagatggaagagtggagattggatttgcttctctcggaatacggacttcttgccttccatgacaatactctccatgagaagcgagcttttgcaatcgacacttttatatggcctcatcacccataatttcatctccttcatttatcttgtttatatttcttaagagtaacggagattgtagagatacaacattggaagagatgacaaaaaccgggatatcaatctaccggatatatatgtcacaaaaagattttagtatatttttagtaatttgatttctactatattctttagttttcattagatctctttatgttatgttatctatataagtttggctttggattttgcatatattaacctttccgttcaataaaatatagttttaccgcttcttatggtatcaaagccttcatccaaaacttactcaaatgagattgactctcatgttaaaacagagaaaaacagagaaaaaacaaaagatcattaaagtcactatataaacatcatgattcatctccatctccacccttaatttctttactagtccgttcgttctcgccactattgttgtccgtgattgtacttcttcataagcatcactgaggaagcaaattctaaaacaatagtatcttttaacaatcataaagtaaaacagtttttttttttttgttcttatatatatactacttattacacatttaaactttggttttgaacagtgaaaatgttgcttgcaatttttttaactttgtagaaatcaggcaagttcttaagttgacaaatgacatatactagtaattttcacgaacgttatcccactaaagtagtcatacccaaaacaaaattgtttaaataaaagtaacttaattatatcattgagattcgagtgaataatgccaatgaaatttaatattcattatctgacactctgaaactatgattaactacataattatttaatttaacgtttgtaccagctaatagtatacacgtttttatgacaaacatttttgaattttttgagttaaaaaataataatggttttcgtcgtaataggagaggacagacaattccaacgtgatatgtacgtttatcatgttacttagtcagcagatcatttcttcggattatataatagctatttagaaacattaaaggtgtggattatattatagtcaagtctttccaatatgaatattatatcatccaccaatacataattattgtcaaatacaagttgagtcagattagtcaaatacaggcaaccaagactcgagatcctcatcgtctctccactttatataaaccccaagtcagtacttctcataatataccaaaaacgaaactgagaaagaagttttatttattaatta

SEQ ID NO: 589 - DNA, 3000 bp, Arabidopsis thaliana
atctttattcttcatgcttgcctagcaacataggcgcacatggatttttgcatacgcacatgcatcagactaatattcactcatgtttcatgaacttgattcttacgttcaaaagaccgaagtgataacatacaaagtttgattagacaataatactccctaagaaaccatgaaaaaatgttgaacatagcttcttcaaaagctgtaaatccgtctaccctaatgtactctacctgccatattcaaaccagagaccgaaacataatccccttgagtatctcaccctgtagggcttcggccagaaaacatacccctgaaaaatcagttcacattagaaggacgcttggtttctttatcaggcagtatgttgttagggaggttaagctctggtggagtttctctcactattccgagcattgagtcatactcctcgtcctttagagcatgcttcttgcgtagaaccttctcgaactcaatcacatttaatggctttgcattctctgcagcgtgagcctgtgcgaggtttgagtagtttgttgctgactgagagataaaagcaatttcctcatcagtgagcttcctgaggaaccttgctgggtttcctccccatacctgagtcattatagaccaatgcgaacattttaactctgtcagtcaatatggcggatgaagtaaattttaaggccatgatgagagactaacaccctttggcattcatatgcagataaaccatagctagaagaacatttccactttcatctaactaacatttataatctgttagggcatctgaaaagtggataagatacgttctatccagatagaggagaagaattctcaagactagaaactgtatttcaatttcacaccaacctccaatactttcagccaatgaaagaaagacactaataatgtcaataatatagcctatgctgtctaagtagcaatagaagtatacccgcaccaatggttacttgtgggttttcaggtaatcagaaatgttaaacccaaaatcatacctctccagaaggaattctggtgttttgtcgtacaagtgcaccagcagcaaccatcccatgcttttcaacaacgaccccatcaagaagtgtcgcacccatcccaataaaggtctcatcctcaacagtacatccatgtaaaacagcactatgacctgttacacatttaatttaagactatatcccaaatgcttcttggagatgtatgcatattaaacattttcaaaataaacagtgagtaagagattcccactaaccaatggttacattgtctccaattatggttgggtgcaccttcccgcttaagtttgattttgccacatgcacaagtgagttgtcctgaatattagttcctgacccaacacttacggtgttcacatcgcctgcgcagaaaaaaagagagaaagcaagtttagattgtatgttatcccagtttcctggtaaagtactaacaggcttagccatacagtaccaatgtgttatgacatgaaagcattctgtaaaaaggacaaccctatttcatcaccattaaataaaaatccagactagccaactcatactcgcaataaggattcaactcaaactcaataatctgtatatgatatcgttcaactaattctggtgttatgacatgaaagcattctgtatatgattggggatatcatatacccaatcacccattagagcaactgccagtatcatcaagatacgatatgtagtaatgatctgtttaagatccttcaataaagctagaaagctccattttgagtagtagtcttgttcatcgcttaaccagaagagtaaaaaacagatattcgttcactattttctatcgtaagagttgacacagctaaggatacagaagtagatactatttcaaacaaaacttcagtcactaaaatagtcaaccaccaaacaccaaacattgaggcttagtagctagctcacctcgtaatacgcatccataccaaatggacgatcctcttccaatgtgaacgtccccaataactgaggcgcttggtgccacaaaagcttccttgtccacaatcggagccttatcaaatacattcatcagtgtccgatgccttgacactacacagagaaaaccacaattacatataagcaaatttcgtgaccaggaaacaaaaaaaaaactaagcagcaaaacacattccacatcaattaatcccttgtgccattcgaatccagaatcgctatacctacaaagacatcaattccagatctctaacctaaccagaataggtgagctgaattacccaatcgaaactcctcactctttacgaattcgaaatcggagtgaaaaatagagttacgcagaatcttacgttgttctcggaagtaatttttgccttgaaggcgacaaccgaggcgatcaagagcttgaccagtctcacggatccaaaaaccgaccgagtaaaatgctctgcctagggttcccattgatcgtcactttcttcgagctcacaggtaaacgaggactcaacactgaatgaagaagacgaaaatggtcgaagctgaagaagagacggaagaaaaaaaatcagcgaaaatggatttcaacaggaacattccgggacggcgaaacaataaattacagttacagtggtttaatatggtttaatcgaaccaaaacaatacgaaatatgaaccaaatctaattcgatatttcaggtagtagtttcattaaaccgattatattattcggtacgaatttattactatattttcactaaattgaacggtccaaaacctgccgaccaaaaatcaaatggccctatcagtaacaatgtcgtttcgtatcgtcgtcacttgcaacgcataacacgtgagaaaagataaacatcgggtaaaaatggcccactggtgggtggagaatggtaataattcagtttaaaagctaagccttctcactgattaactcaatcattcatccgtctctgcaaacaaaggaagaagaatcaag

SEQ ID NO: 590 - DNA, 3000 bp, Arabidopsis thaliana
gaagtccacttgataacttccttgtatttgtaggcgaagtatttagaagctttagcctctgagacacttctcacaagcgatgaagcagtagttgtagcagcagcagctgaagcagtcgcccttgcaagagctgctgtcaaagttgccaaagatgcaacattatttaagaacagtaacaacacgaacctattaacttcgtcaacggccgacaaacgctccaagtgggaccagtttactgagaaggaacgtgctggcatattggggcatctagcggtttcggacaatggaattgtgagtgataaaatcactgcatctgcctctaacaaagagtctattggtgatttagaatcagaaaaacaagaagaagttgagcttctggaggagcaaccttcagtgagtttagctgtgagatctacacgtcaaactgaaaggaaagctcggagggcaaaagggttagagaaaactgcatcaggtattccgtctgtgaagactggttcgagccctaaaaagaaacgtcttgttgcgcaggaagttgatcataatgatcctttgcgttatctaagaatgacaacaagcagttccaagcttctcactgtcagagaagaacatgagctgtcggcaggaatacaggtttgtcaccaatattccaaattctaaactaaccacctccctttttctacatcgcgtctgagacatcacaaacactcacccttcgtaggactctagattctaggcgaaaatgatgtctacaaaatctttagatgtttgagaatgacgaaattagtggttagtggtagaatccaagatcgcttctttgtgctttctagccaatatatcatctgaagttctgtgaaagctaattatcctgacatgcttgtcttaaattgaattgtcaccttttttgttcttattatgtagccattcaccaactgtttagtgttgatagaaaatgggaaacgtatgttcagctttggaagaatcaacattacttgtgaacgttatttcttcttctctgtaatttttcttatctttctttattgtggttttgatcacacactttggtttctttgtttaggaccttctgaagttagaaagacttcaaacagagcttacagagcgtagtggacgtcagccaacctttgcgcagtgggcttctgctgctggagtcgatcagaaatcattaaggcaacgtatacatcatggcacactatgcaaagacaaaatgatcaaaagcaacattcgactcgttatttcgattgcaaagaattatcaaggagctgggatgaacctccaagatcttgtccaggtttgagcttttctctccttatttttttttgtaataacacatctgtaagcagtagtgatgaaagtgatagatattgaacaccttgctcaaatattttcgaaatggtcacaggaagggtgcagagggcttgtgaggggagcagagaagtttgatgctacaaagggttttaaattttcgacttacgcgcattggtggatcaagcaagctgtgcggaagtctctctctgatcagtccagaatgataagattgcctgtaagttatcccaaatgtttttcttttttacttgtttaaacaaaaggtttgggattatgcctcaaattttaagggatgattggcagtttcacatggtggaagcaacatatagggtgaaagaggcacgaaagcaactgtacagtgaaaccggtaagcacccaaagaacgaagaaattgcagaggcaacagggctgtcgatgaagagactcatggcggttctactctctcctaaacctccgaggtcgctagaccagaaaatcggaatgaatcaaaacctcaaaccttcggttggtaccacctgacacaacacacaccatacaacatagacttgttgtttgtctaaaaatagtaaataatatgagatgggtttgtaatgtaaaaatatgcaggaagtgatagcagatccagaagcagtaacgtcagaagatatactgataaaggaattcatgaggcaggacttggacaaagtgttggactcgttgggtacaagggagaaacaagtgatacgttggagatttgggatggaggatgggagaatgaagacgttgcaagagataggagagatgatgggagtgagcagggagagagtaagacagatagagtcatctgcattcaggaaactaaagaacaagaagagaaacaaccatttgcagcaatacttggttgcacaatcataattctttttctcttcaatatggaatgttttgtgcatagaacccacccacctgagcataacaagcagtaaattattactttttagcatttacgattcttgtgacaactactaaatcgaaaaaattattttaaaactaaaaagaaattgttgtctgaaaaacataagtgatatacaacaataaataaatatctcttataagaatttgggaaaaaaaaaatccaaagattagagatatttgggtggagaaaacaaccgcctaggacaaaaaaaaattgtgggtagaggaggaggaggaggctttgttcacacaccacacgacggaacattctcttccgagtcttatccaaagcaaaatcatattttgcttaaatatcttcttctccggctctgtctctgtctctcttcttcccgcggagctttcagtttttgtttggtaacatcgtttctctttctcactaactctgatatcatattatcaatttttccttttcaacacccaaaatcacaatctttcagctttattctgtttttccttgcttgagaattgtgttcgattcatgtctacgaactgaaatcacaaattttgccaacgttttatgattcctggttccgtatttttttttttgtaatcaatagttagctcatttcgaataatcaaactcaattttattgttcatgatttgttatctgggataaaagagagtaatgtgctaattatgtatactcaggtattgcttggtgtggggaagattagatagtgtgaaga

SEQ ID NO: 591 - DNA, 3000 bp, Arabidopsis thaliana
tctaagggatcagcagggacatcaatataagaaatttcgtcatccttgagaaggtcattttcagaataactatgacggatttcatgatgcttttcctcagcaatgttcgacaacttttcaggataactatgtacgggttggttattccatctcttgtcaatggaaccaaagccattgttttccgaaaacagctgagtagttgtatctcgagcaaatttggtaaccagagaaaacttctctagtagatggattgaaagatcccgagttggatcatgactcttttgctttctgaagccagactgggaaacactagatactctattaccaacatctgaacttgttctcctttgattttcactagaagaacctccgtctaatgggtatacggattgtccacttgctacaggcagtgaacttggcagctccaatgaagacaaagttctctatcggatattatgataaaatgtattagccaataagagaattaaaaaaaaatcatcactgcacccaacatgagatgatctgatatgattacctgcaagggactctgaaaatcattcacaatgaacacattttgatcttctgacgacctataaaaagctagtatcatgtaagactatgaattctgaatattttctttgtgacataactatgtaacgagccacccagttccatacgataataaactcgggtgaaccaaaagttttcatgttagacctctctaatgagtaagtaacaagtgctataaaagcctgtcaatacattgacactgtgcattcctaagctactttcatacagtaaccgaaacagactataaagacaggttataaataagaatatcaatacagaacaaaaaactatctcatatcagacacaaaccttgcaagaaaaacatgctgcttcaccatggccagaaactccctgactcctccattgtagaagtacagaggtggaaatgcaagtcctgcaggtcattttaaaccattaagtctgaatcattcgacttgtcgagaaggaaaagggaaaccccctcccgtatagtaattcattatatatatctcacaaaaagcaacagccaaaagttttgcttaccagaagacaggacaacaattacatactgccatccgagagcaggagtgtgtctcctaatggacctcacttcagtaaacggaaccgcggtgatggtataaagactcctgtctagaaaagatatagaaactaagaacaaaggtaaagcattaatcttcaatactaacatatactaattcagttcaaggaatcctaaatacctttctctgatagctttgcatttgatgtttgtcccttgtacggaatccacgactagccatcatatatcaaaaaatggaaacaagtaagtgaatgaatacaaaactaatacaaacaaacaatcaatttcagtgattgattaccagaaagagaacagagtcttgcttagtcaacttcaatctaccactaatcctctcagatgcgaactgtgtaggatgaattgcaacgttatctttcaaataaatcaatacagcgtcttcgtgttcactttgtaaacttctctttccgctatcgctacgcatcatactagccgatccctaacaaaatcaagagccatagcaacacaatcaaacgatcaagtcaaatagataatggattcaaattcgcattggcgaagatttattatcggaaaattacgatcgaattgttgaatcaaaattgagaaagcacgagaagaaggacaaagtcagaataacaaacttgttgttgagaagcggcgtaatcggcgtcgtcagagagatcttgtagctccgttgcttccatactcatggtgatttcaggagaagagagaggtgatgagagagatcagattaccctggagacgaagtaagtaattagagaggaagcttacgcgtcgttgagaatattcgattacgtgtgtgtatcttcattaattttgcagttaaaaaggttttaattacaggtcggcgttgtaaccgaaccgaaccgaaccaagttgtaatcgaatcgaatttagtcaactttataataatccgaataatacgaaataagtttctttactatagtagtaaaatgcgaatttggtgtaacagaaccacattaaccagaatttatcagaaatgcatatttttagttgagtaacatactaatcaaacagagcaaattaatatttccttttagttaaaaccaaagcaaattgatctgtaactttaaacaattagtttatgctgcggctttttagtaacttttctgggctctgatcactcacatagtcacattcatatatttcagtcataacttttgctattttgttttgttagtaacttgtcaaaactacaaatcaagctgaaatctgttttgaaaatgcatggaaacaacttgtgtaaattaaaccacctgtagttgtatacttgagatcctttttaagtcgcacaagtttagaacgagaactagaagcttcatgtcaagcaatacctcatttacctttgaagagtgtcatctgatgaaacaatatgaacaaataaggattggacatgtggaagttggtgatactcctcttgcctattcggtggaagaagaggccacgtggagccattaaatagaagtggagtgattcgctgtcgatgacttgggaaaatcctagaaaatggcccatcaggccatcacctctccttacctcaaattctaataaactcactttttgtatttgtttatatgcttgcttttgcgaaatgtttttcttattataaacattaacaatattattgtaattgactcaacatataaaaaaaacaaaatggtatagtttttatataatttgtttgtaaaagaaaataaaaatgtggcctctctccatttagctcttctctctgcaaagctttaccacacaatagtctccttgtgtttctctttatatttgtctctataactctctttcgttaaagtttcataaaacctcaacgaactccttcc

SEQ ID NO: 592 - DNA, 3000 bp, Arabidopsis thaliana
accaatactgctcgaacctttgtcttgcatactccatgtagtcaaagtcgatttcattcacatgttcctgtaaagttttacaaaatgaaaatcaagcctatatatggttcagaaaatgcaagtatgatagaagagtattgtagaaattaccgatataattccccataaaccccaaattagatgactagcaagtgtatatttctcaacgtcttctaggagttttttgaccatagtatcgctgggcttttcatctggactcacaagaacaaatacaaatagagaattatggctgtacagtgatttattgctgaagctcatagcaagaaagtgtgataaaataatcacctgaataactcatatatgttttcagaaatctttgtcgctcctccacacctgttataatttagtcacatattaagatatatgattgatcttctatcatttcaaaagataaagaaagatgactttgaaatagacacttaccagggtatttactataatccatgatgtgaggtgtttcagtgtggtaatcggcagccatctcacagaagtgattggcaatgtcataagccacaggattatagcatgaatattcataatcctattttttataagacaaaataataaaatcagagttaggatccattttttctagtaatggtatacgaaaaaaggagagctgactaaacaaattcatgaaaccttacaatgatggttattgctttggtctcttcatccatcatgatgttcccatactgtaaatcattgtggcaaaatccaatattttcatcattgtcaaagagagatttctcaagcatattaatttccatctccataacatcgagacgaaaggacttagcttcttctggtgaagccagtctcttgcatgcagtgagccaatttctgaagttacaaaaaaaacaaagtggagaaaaagattacaaaaaagaacaaaattttaatgatttgttagaaagcaaagtagaatctggtagaaagcaaagtagaatctggtagaaaacaaagaaatgtaccgtaatctgtcccaaagcaaagcctttttcgcaccaggcatttcaagaccatgaaactccttcatcctagttgctattcgaccagatatttcaggatcacgcaagtcacaagcagatagggtctgaaagttcatagttcagcaaacaagttacaaattcagtaaacaaatacaaaaagattcacaagaattacctgaagaatgaaaaaaaccagggaagtgcaaagatactcaataacttaggaacacacagaatcagatattaaaaaaataattacccgtgcatggaggaactcttcgatacgaccattaccaaaccgacctaacaacaaaggtccatgaccatgcttcgacatgaactcaaatgtcctgatctcatcctcacgatcaaagaaaatctcaacaccttcaccataaatcctaaccaaaaccttacgagaaggacctttttccctagttggccatttgatctgaaacacctcatttgtcattgcaccttttaaaggaataacttgcagagcctttgaatcaatcacatcttcccactctgatgctattgcttgtaaagcttccttgacttctcgaggcaaacgatattgtttattctctacattcttttcagtaccacccatcgtcatttgaatgccacacacaaagataaatctctctgtacaagataaaaacagatacttttagcgaatacttataacaacactgtgttttgtccaattcaggggaggttctacgatcaacccaatgcaacaattctatatgcttccgtttcataaaaattctgaatatcaatctaaacctatacaattacatccttactaatctagataaagtgtatacaataaaatgagagcaataaggttcattaatctttatacttagctcctccacaggacgatatactttgagactgacacaaaacaaaataaggaagaaagcttacgtttttgaaggaaaatcacaggagggacgcggaagcaagattggtctgagaggaaaattgaggaagaggggttaatcgagatgaaaatggagtttgaagtaatagagagaacgttgcgcagatcgaggaagaacagaggataggatcaacacaaggatcttgtgaaaatgaaaatggctgaggaaatgaaggactatttgttaaataagatataatattatttctgaaatatttccatctgactcctttaatttatacaagcctccttttttgtacatctattttcagaagatccaaataattgtttcttctatttgtgtatttttgatatttaaacgtaaatctttggattttgatcaataatagacaattagccaagttcagttttcattaattagatttataattttaattatttttagcattcgtctaaaattaaataatgcggcaaaagaggagaaattaatttttgttgttattaattcaaagcgttacaaataaaaaaggaaattccacgctggcaataaaataagcgaaaattccacgtgacatctacctgtcggatcaaaaagagtggaattgacatttgtttctctcacactctctctcgaattctctggtagcttctagttctatgcaaaaaaacgacgatagttctctatctttccagatgaatctccttccatatacaaaagcagtcatgcctcctcgctctctcgcaattcacaaagtatccaaacatctaaagttatcaattttacaacattaccgctataatctgcttgattctctgcaaaaagagaagactttttaccgagaagaagtcctctggctcattgaagaaactcaacgaaacaaacccagttctcatatatcgttttaaggtaaatgatcgcgacaatcttgttctcatttgtgtgtttttgtgtttgtgattagggtttacaaaagatactgagattagtttttttttttttttttttttttcagggattacaaaagctaatcgaag

SEQ ID NO: 593 - DNA, 3000 bp, Arabidopsis thaliana
cgagtcagttcgtcgcggctcatgccttgaggaaaggaactgcaagagcccaaagccagctccaatcccctcaacagaaaatctgttgcatgcagtttctctgcaggatccaacttctgcttcctgctcaagaatcttgtatctggtctctcccatgatatacgctcctgttgccaaagaattgattagtcagaaacagataattagtcccacaagacgggtcaaaacaaaagagttacagttatataacagatgatatttcagtgattatgcttaattttgtttagacagttggcttacatggtggattttgatgttcttgagtgtgtttttagctgctgcagacaatgaagcagcccgtgcgatcaaaacctgagctgtggtgttgtctcgtgccatcatgatctccacaaacatattcaacctctcaagagcattttcagcatataatttgcaacccttactcatctgcaaaccatttaaaacccaaggtaagtattttgtgaccatctcatcgtcgtggaaaaacaaaaaaaaaactcaagactcacctgactatgagccagccttggaaacgggagaagcactgcgatgagtgaagcaatggctccaagtgctgtactgcctgccacatgaaccgggagcatgaatacatgagccacctctccattgaacaccacaaaagtcacgtagactacaacaatctgcccaaaggcaatccgtttagtcagcagactcgtggacacggggaaagccactatgaatgaagctagagccacagcaactggagccaccaagccattccctagtgaagctggtccaaccaccaagacactcactagcgcaatggctattgtctgaaaagtggcgtaagagacatcaagacagcacttgagaacttcgccgtatgttggttcagcatcggagagccagatcaagattgtggtcaggtaagaaaaggctggaaacgttgtgaagtgtcttagtggtttgggaccgtacaaagtggttaagctcacgatgagacaagccatggcggttcgcagagccaggccaagtcgctcgagccatgttgtgtcgcgcattcttttaacggattgttgttttagtggatttgtatgtaggaatacttgttagataaagatgatgagatgaaggttatggtgagcaagaagactacgtatatataaggtgtgatgggatttaaagtggcaacgtcaaagagttaagacttttgagcagctgtcttttaactccaagtactttcattttctatattgtgtagttaccaaaccaaaccagtctctgtactgcatctggttagtttcggtttaggcagtgcctcatacatcaaaggagggaagagacactgatatttcaaatagtttgggttaaattaggccatgccatatacaaatagttggaagggaaactaattttaaccgaatggattacggtttagtttggtttaggccatgcccatatatccggtttcggtttgacttacactgttctagttttggtaccaatttcaagtttgattgtgtcttcttattttccgatacttttcgtatatatcgaagaaaatgtaactggtgataaaccgaaataaaacttgaatcactttttggatacagcttggtcagattaaaccaaatgggacatctctaaaattgaggcacgtataggttggaaacgagtcaaaaccagctggtttcatactctaaaactaaaacataatggtttcaaatactaattgataaaacagtattttctacaagtttctcgagagtttaaaatgttataatttctccacgtaatcgacctttcatttctcgatttaaaatgtggtagaccgaaaaaagggtaagattaaatataggaataagacaaaagagaagaagaagaagtgatatgaaagacattagtctcatcaacagttcgagttcaagtagagatcgagagcattaatcacaagctgcacgcttcatggttagtattgtttcctcttcaccaggtaatttccatggcataatcaatttggtcctactctatcatatacttggtacttgtacacctattttatttccaatttgtggctacaaatttctgtgccacaaaaattcgtttttttttcaatagaaattttaatctgaaaatgagttccctttttttttggttgagtttctatattggttatttcattgcatttataaattattttctttgagaatgttaaagttattacatagttacgttacgtataccgtccactttgcatgcttcttccacgtattgtttggggcttattttagctatcaaaagaggaaacccaaaactctttactctctcgtcaatctctttcaattgtgtgtacaattctttgggcttattgtgaatatagctcgagcaactcaaactattcaaactcatggaccatgtcaacaactgccctgaattatcatttgtgtaaaaggcaaaaacctatgcagcatacaataaataaacacattaactttttcttgtttttcaaattttctccaagataagcccattgggcctacagctagttttgggaaaaaaaacagaaaaacgaaaaggaaaaaagctatcaatgagtcactgacggtgaacggtggaccgactcaaagccaatgagaacgcaagaaaatgttgagccaatgaccgacttttgattatggactaagccatcgaaccgaacattctcgaacctttttaaacggctttccttatttgttaaaggaaaaggaaaagtaggagaaaagaatcattcctggaccgtcagatccaactccaaaagatcgtgcggttacatagcgagccatcgaaccttctcgaaactcgagtacaagactctatatagacttctccttcgacctgatattttggaaaaaagaaaacaaacctagccgcaattcacaattcctctttcacaatctttctttcgattttttagcttaatcctgagtagcgttaaca

SEQ ID NO: 594 - DNA, 3000 bp, Arabidopsis thaliana
ttgaaggtgcttcctttagtgatggctcaggagatctacatgagtggcttgattttggttttattaaaggatcgagtaaccttctcaatggactagacctgcctctgtttgctgcactggttttatcaaaagaagagctgtcactgaaagaagaggcagatggattgtctaaaccagctcgtgatgaaataagtgctgtgcttaagtgtggaggagtcttagcatcttcggtgttggagtttttactggactttccaatgctgaagctgagtcggcgaaatggtgaaatgctcctagctctttctgataagactttagctggtttctgatctgactgtttaggtaatgtttctgttgaccttctatctagagtcctgcttctagagggactagattcagcctttcttgatcgtggagctgaacatgatctttctgataagaagctgatacgttttaagaatggcttacttcctccatcagcttcacgtcggaaaggacctacatcagagtcaagaactgcagttttcccatgcgctaacctctctgtgaacccctttcggttactttccgccaatcgctcagctagtaacactttcgaatcatagaacttggacaaaccaataaactgtttctgagaaacaatccctggtacaaatacagcagcaggcttttcttttccaaagagatcatgaacacgaggatttcggattctctcttccaacttctctcctttcttcttaaaatcctcggctagattctttgatattatccttgtgcaagaaggactatctggcttcgatggactaaagagagttcttgtctttggaacaatcttaacatcagtatctttcttctcattctgttggaccgcagttgcacgaggggtctgatgaaactgcccatctcttctatgactgtgagaagtatcaccgttatcttgaggtggctccaaatcttgaaaattatctccaggcttagaagacatgagataatactgcaaaggagggtgattgatctttttacgaaaaggagaagcacaaagacctctactggaatcagtcgatgactcatcagtccagagagaagacgatgtacttgtattagacaaggaagacctcgtatgcttatccatcagtttatcaatcccttgcatattccttagctcctgtgaaccaataacaccaccagctttaacactcttgtcttcaactttatcacatttctttatataactcggcacataagacttgtacttcacaagatctctttctcctgaagcagttctacctatccttgacttcaaacgattctccaagcgtttaggacatacatcttcaacttttttcgtgatctcgcggtggaaatcggagtaagataacccgcgtttatcgtctctaaacttatccggtgtaaatgcctttgagctttccttagttaataccttcttctcagcagctacaaatggtggtctatcacaagaacctttcttcaactccaaacgacactccatctgtttccaaagttccaaacgtttcactcaaatgactcctcagtctcccattaaactgcagaagcttgaaacgctcaacattttttttcactgtagaaacaaaaaaaatggtaagtcataacaaataccaaaaaaaaaaaaaagtacatctttcttatccacacacaatgtaatagaattacaaaacgaatcttcatagaccttatagatccttaagaatccgtaagatctgattagaagaatctctacaagattaaagctgaggaaaaaaagtaaaactaaagtatcaaaagaaccaaaacaaaatcacattcttctcaaactttcttaatttaccaaagaagtactaaaaaacaagattagtaacaggaaaggcctaaagcgtacacacacaaagcaggaatcgatgaattcacataacactaacaccaggactaacacgagagtgttattggcagtgtcagagagtgaaaaagcttggaaaaaaatcgaaccgtacctgaacggaatcagttcgtaacacagagactgaagcagattagagttgaatcagatcaggagaggaaaaaagaagaaggaagaacagatctcaaatcgtccgtgaaatccggcagaaatagcgccgacgaagctgaccctatcagctacagaggtagagagtaagagaagagagagattgagctttgttaattgtgtgtagattagagagtgacaagtagagagagatagagagttgttgaagcgagtgtgttttgttcgccgagtctttcgtcgaagttgttttttttttttcccaaaaaaaaaaaacatatctttttgtggccgacggatttagtaaaaaaaacagtataatttttataaagatgggcccaatagtagaatcgtacgctcaagattccgtaatgaacgcgggaagttacgtcattgtgaccctacttacttagtggagctcaatgtccaatatacaccgttggatttgtttaatcctcctttagatgggcccagtttttagtaatattctattcaattcagcacgttatacaattgcttttaaagcccatggcccataatactcagacagccttaaatgcttcagattaacaaagaaaatgttttagattttatggatagtgtgattagagtccaattattttggaatttaattcggttaaccagtcgaaccggataatctgtagaaatccagttttttttttggaagactacatatttgtctaaagcccatgaaggcccattaaacccaacgaacacaaacaatcttcaaaatgctcctagaattttctggattcacctgatttttctcatagacgtcctctagatgtttctgtattccccataacaactcgagaagctcgagaaatttcggttagtacctttaaatagcttcaaaaatccttcgtgtgttctatcagaaatcgaaaaatcaaagttctcaagaagatatcaacaaaaaaaaaagtaaattctttaaa

SEQ ID NO: 595 - DNA, 3000 bp, Arabidopsis thaliana
ctccattaattttccaactacaaatctttcttccgattttttcttgacttgtgtatttaataattgatggaatcattaataacttataaattaatttcttaaaaagcattttgataattgaaaagtgtgctctaaatacaatattccgggtcattatgttttgatttgtcgactgcttttttcaatttttaaatcctcgtaataaatttaatatattatttttcagtctttaatgaaatgtaatttggtattattagttactaacatttaaaagaaaataattggcttgtaaagaacgtatggaatgtgtcgagtatgtgtgtatagtgtctccacttggatctttcttacttactccattatcttcttctctctctttccctcatctcattaatggcgagctctacatctttagcgatagttcttcatcaatcttccaatcatgacgaactcttcatgaagcaaactcttcaattctcagaaaccctcaaggtttgtatgatcgttctctctatctctttctctcctcaaacatagattgatcaataggcaattgtgattttttgtcttcattcaagattcatcttctgttctgttttggtgttttaaggatttaaagaatctgcggaaacagttatactcagcagctgagtacttcgaaacatcttatggcaaagcagaacacaaagaaacgtaatcttacttgtctttcttgatactaacgatagtatttttgaactagtccatgtgtttgttgtggcgagtgattttgatgaatgattgcagagtgatagagacgttgaaagagtatgcagcaaaggcagtagtgaacacagtggatcatcttggttctgtctctgacaaattcaactcttttctctctgataactcaactcatttctccaccactcatcttcgtttatcttctcttgaacaagtaaacactcgaaatcttgaatcatgaatactcttgaaactgtcttacatttggtatgtgttgttgttgtagaggatgagactatgcagagattacatggggaagagtggcactcatcagcatttgcttctatttcaatatcctcgccatcataagcgttacttcttccctcgtatacctttttaacctcttttccccctcacacaattgatccgttcaatcataatccgcccttatatcgatggttttttttcacagaacaaggaagaggcacaagtttctctgcaggagatgactcacaccggttcacgagtggtaactaaatccgtttatctatatctgattgtttagtttgcttctgtttatacgatatctgaatctttctcctgatctgctgcttgaaagctgttcgatcaacaatactagaaaacctcccaaatactgcaaggtataatcttgattctcttcttcttcttcttgttttgttgtttgtaatacgattggtttgtgaaatgcaggaaagctaacaagacaggaagcttctcttttgcacctatcgtacacaacaacatcaacaacagaacaccaagtacttactactacaataactaagccgccatctttctttacttgactttaatcagaataagttcaatcaattaagtgtgtgtgtgtgtaatgttgcagataagagatcaaactctcctatgagattccctctcttacgttcaggatctctactgaaacgttcaagctccccaagccaaccaaagaaaccggtatatatagataatagcacttacaaagattattttacttcaaaatttcaacatctttggttagttaattacttttgctgctatcttttgtgtattgtaaaagcccttagcgttaccggaacctcaaagagctatatctgtgtcgagaaatacagagatagtggagataaagcaatcttcatcgcgaaaagggaagaagattctgatgttcaaggcattgatgagtatgagcaagtcgagaaactaaaatctctccttgtatttgataaatgaaaagatttgtacaaaactaatgtgaaataagagagagagatgcttattttgtcgatattagtacttttctttcagatgctttagttgcaattcaacagaaaccatacgaaaactattttcactgttagtttcgtcactttcttctacacaccgctctttttatctttgacttaagatagtcaaaatcacacgttaaggtaatctctctttatttctttaaggttacatccaaaaatatattagtacgagccatcaatatttttctaatagtgcaaataattatttcataatttcgaagttaattagtgaaaaaatttctttgttaacggtgatggttaggggtggacatccgggtacgcagatcggattcgagtaaaacctgattgggtacgagtcattcggatagataaatttatgatccaataaaataaatctaaaatattggttcggttttggttcggatcaattggctataattttcaggttcttttttggaatcgaaacccgaaatttcaagtaaatacttggattttcggattaaatttgagtatggagtaaaatttatatattcgaataaaatatttagatacgatcaggttcggattcgtattcgatttcaaatccaatttttcgggtcagttctgagtcggttactcaggttccggttcttttccactcctaatgatgtaatagaagaagactggcccaacaaaagctcattgtctaattaagaagaagaaacgaagtaaccaacggccacgattactccaacacaagaccaaatctgattggttgacattatagatcgtcgtaagataattggtccacgtcatctccgatgacatagttaaatttcttcgtcttccataaaaagcgactacttcaccatcaccttcgggcactggacctatttaagcatcctaacttcttcttcaaagcttaaaaaccagaaaacaaaaggaagctctctgttcaaatcaaaaagagagatcgtacgcaaaagtttccgat

SEQ ID NO: 596 - DNA, 3000 bp, Arabidopsis thaliana
gcaatcttggttctgttttgggagtcctcgtggatgccgagcttcaggtttttagagaaagcctcatagaacttgttgtagtcctccttgttctcggcaatctcaaagaagagctcaagacacttcttcacaaggttcttgcggatgaccttgaggatcttgttctgctgcaatgtttctcttgagatgttgagaggaagatcttcagagtcaacgatacccttgacaaacccaaggtaatcagggatgatgtcttcacagttgtccatgatgaagacacgacggacatagagcttgatgttgttgggcttcttcttagtgtcaaagagatcgaaaggagctctcttgggaacaaagaggatagctttgaactcaagctgtccttcaacagagaaatgcttcacagccaaatgctcctcccaatcattgctcaaactcttgtagaaagcagcgtactcctccttgttgatctcctctggcttcctcatccagataggcttctgtttgttcaccaaatcccactcatgagtaacctccttaatcttcttctttttcttctcctccttttctttctcctcatcaatttcctcaaccttgccttcctcatccttcttctcttcctcctcttcatcatcagagatctccttctcaatggtcttctcaatccagagagagattgggtagctgatgaactcagagtgcttcttcaccaaatccttaagccttcgctcctcaatgtactccatctggtcttccttgaggtaaaggatcatctttgttcctctaccaagagcctcaccagaggtgtctctggtcaccgtgaaagatccaccggcctgagactcccacacatactgctcatcgtcgttgtgcttggtagtaacaacaaccttgtcagcaaccaagtaagcagagtagaaaccaacaccaaattgaccaatcatgctaacatcagctccagcagccaatgcctccatgaactccttggtaccagaccttgcaattgttccaaggttgttcaccaaatctgtacaatagaacaaacacgaatcagcaaacacaaatcaaacacatagataatggttttgaatgaaatcaagtacaacttgcttttgaatgaaatcaattacgtaccagccttggtcatcccaataccactatcgataatggtcaaggtgttgttagtcttgtccggaatgatatgaatgaaaagctcaggctgaccatcgagcttgctcttatccgtcaaggactcgaacctaatcttgtccaaagcctgtttcaccagaataaaaagctcaatcataagtaacaaaatacacacaacatatatacaatcaaaaactaagtaatctaacaaatttgaacatgaaaaggttccatcaattaacaaacgaaaatctcaaatcgaaaagaacactaaaccctaataaaacctaaatctacacatagatccgtcaaatcaatcgaaggagatacacaaacacattaagcttaaagataaacatagaaagacagagagggagagatcgtacatcggaggagttactgatgagttcacggaggaagatctccttgttggagtaaaaggtattgatgatgagggaaagcaactggttgatctcagcttggaaagcaaaggtctctgcgtccgccattatcgttgatcgggaaaaaaatctaagaattagggtttatgtgaatcaaaaagcaaattcttaagagaagcagagaagtattgatggtttgattaagggggaaaagtgtgtaatatataggggatgtggaaacagacgtcataatataatggaaattgtaaaatataaaaattgtcataatattttactttccttttttttggaacaagtgctacttactttttttttttttttttttgttaaatttttctattagctaaactaatcaataaaaacaatgtttttctccatatacaaaattcgattttgttatggatttgaatttacaagttcccattcattctagtttatctatgtttagatttttttagatcggtcctagttttgggttattttttgaaatcgataaagttaatcccttagtttcaagatatctcaaaattttatttcaaattttagttatgtatttaatttataacaacaagataaatagttgtgttaaaaaaaaaaaaaaagttttaatcaattctgaagttaaaaaaaaaaaatcaattttttctccccacaaaccccacgctttttagagaatatgtgtttctttttgttattgttttaatttatttattttacaactttcaatattattatttaattattgatttttttgaaactttattaaaagatacacataccaatctgtaaacaggaaaaaaaaagttgtaagcaaaaaataaaattattgctttgtttttaaaatagtaaattatcatcaataaaataaaatagtaaattacaaaattaacaaaaaaggaaactaaaacctgttacaaaaaagtagtaaattacacctgttctgcaaaataaaaagggagtagaattaaatctgactgttttttataaatagtaaattatcatcaaccaataaaataaaatagtaaattacaaaatttaaccaaaaaaaaaaagaagtaaactaaaacctgttacaaaaagtagtaaattacacctgttctccaaaataaaataaaagggaataaaattttaaaaaatttaataaagttttgtatttttctaccaaaaaatagttttgtattttgtaatttccatttaattatattgcagattatgtggacctgaaaagcaaattaacataaatcaaataggaaggatctagaaacccttataggttcccagtccccacaccactatatataataacatccttccccaaagtctcgtatcaatcaacacttctctgctctctaaagaaaattttgctctctttatctctcgatttgattcataaaccctagctcttagattttttttccgatcaacgaga

SEQ ID NO: 597 - DNA, 3000 bp, Arabidopsis thaliana
cagtcgacttaatcattaggggtgttgagacattggttatctttttatcttttttttttatgttttcgtttgaactaatattttggaactattttctggagtttatttcttctatcgcttgttttcgtgaagattttttctctgaattcggtttgatgacaaaggttctcttatgcacaatcttgcaaatccaagcttattttggttatgtagcctataactaagttattagtatgactaatatggctaataaaatacatgaagcagctccaaatcatattgttaagcatctcagacaacacagcttacatattctttacaataataaataatttattgttcgacataatactgttgttactgtttgacttagcgttaattttctgcacaaatgttgttactactttgattaaaaaggataatttgtgtaacaattttttggtcagttttaaaggttattattatttttttaaataacttttacgattagaatatgagtagtgcaacgcaaaataacactgccgtttaagacgacggtcccttgacagaatcttcatcaacgctcgatttgacgtctgccgatttccttagctccgacgtaaaccactgatcgtcggtattcagctatattttgatttctcagctccaaaaattcccaacgaaatggagaaaatggccaaaggatggtttccgatgagcggcactagtagcagcggagatcagcagcagcaaccgctgcaaacaggaggaacgtctctgctagctgattggaattcttacgcagcatcgagagattttgaagaagacaccggaactttaggcttcgatatcgaatccgccgttagatctgccaacgacactgtttccggcacctttaatgtgtaatccatccatctctttctcttaatctttaggggtttaacgattgatcgtgaccgtatctgagaaattaggcgttttcgcctgctattgaggattggattggtgtaaattaaatctggaatctgagaaattgtgattaaccatatagtttaagctttgccagattcgttgatcagatttacaaattctcagggtttgaagctattgttagtgaatgattttgattagtgtcttctctcaatgacttagaattgattaagagtcttaagcatatctttttcttgaagtgttactaactttttgattttgaattttgttgtactcaaatctggattgttaacagtgtttcgaaaggagttagagataacctgcagtctgcaacaagtagtatgccttcaggaaaagctttgatgtatttcggtttacttctagcaagtggtgtattcttcatcttcattgccttcaccatgtttcttccagtcatggtgcttatgccacagaagtttgcaatttgttttacccttggatgtggatttatcatcggatctttcttcgctcttcgtggcccgcaaaatcaactcgctcacatgtcatcggcagaggtaataactaataacaaaaccttgtgttgtgcagcttcttatatctgctgtatttcgtttacatttttctctttggaattttaatttcttgtttgctggcttctccagaggcttccactaactttaggtttcattgccaccatggttggcaccatatatgtctcgatggtgctccatagctacattctctctgtgattttctctgcattacaggtacttaaatttcatcttccttcccgactcttgttggtgtttatatcctctgtttttcatatgttaaaattttcctcttccccatttcacaaatcttacctatgaagttcttttttaccctgcatgtttcatctagtaagctcttgcctcgtcgaaacataatgtgtttagtaaaaaacatgtagactttcttattgctgttttaaaatacaagttgggttagtatgaattatgaagaagccttgaacgccatatctttggttggtctcttggcttgtttttgcaaatgcacttacttgcgacagaaacagctttgatatattattactcacccgttatcgatatggaatatatactttaagaactcactaaatcatatccttcatgtcggtttaaagattagtcacgtatctgcacattctgtaagtatagtaatctcataaaaaacctggtctctgttctctgtgaatccataggttattgcactggcgtactactgtatatcatatttccctggtggatcatcgggaatgaagttcctcagttctactcttacctcctctgtcttccgaatgtttgggagatgagctttcgctttgacctatgcaaagaaaataacttgattctctcgtgtataaagaaagatgaaagatcttcaacagtggttaaatgacaaatctggtaaaatatgttggtccaatggctcaaagacagttttgttataaatttcctatattgatactttctgctaaattggttcaaaacttcaaatcactagccactggatgaggtatggaacttgaagagttgcttggtggatacattctctaatctagggtaagtcgttagcttcaatgtcttactgtgaattattacatcagaattaagaaagttattacacgtatgttttcactgagtttactacactggcaatgtggcatacatctcttactgcaaattgcagacaagtggtcaatcaaatcttttttagttgggcccaaaatgtctgttattggatacgttgggccttaaaatggcccccatcagtcaaaaacatcactgcttggagaaggatctagaaaaacttgcaagttagttcaaacaaaataaaggaaaaagaacgatctagaagaaagaaaaaaaaaggaaaagaaacccttatggaggttcccacaccactctatatataataacatccttctcctaaatcccgcatcagtacttctctctgctctcaagataattttgttctctcaatttcattcttaaaccctagttcttcgattttttccgatctacgaca

SEQ ID NO: 598 - DNA, 3000 bp, Arabidopsis thaliana
ccgagcttcaggttcttagagaaagcctcatagaacttgttgtagtcctccttgttctcagcaatctcaaagaagagctcaagacacttcttcacaaggttcttgcggatgaccttgaggatcttgttctgctgcaatgtttctcttgagatgttgagaggaagatcttcagagtcaacaatacccttgacaaacccaaggtactcaggaatgatgtcttcacagttgtccatgatgaagacacgacggacatagagcttgatgttgttgggcttcttcttagtgtcaaagagatcaaaaggagctctcttgggaacaaagaggatagctttgaactcaagctgtccttcaactgagaaatgcttcacagccaaatgctcttcccagtcattgctcaaactcttgtagaaagcagcgtactcctccttgttgatctcctctggcttcctcatccaaatcggtttctgcttgttcaccaaatcccactcatgagaaacctccttaatcttcttctttttcttctcctccttttctttctcctcatcaacttcctcaaccttgccttcctcatccttcttctcttcctcctcttcatcatcagagatctccttctcaatggtcttctcaatccagagagagattgggtagctgatgaactcagagtgcttcttcaccaaatccttaagccttcgctcctcaatgtactccatctggtcttccttgaggtaaaggaccatcttagttcctctaccaagagcctcaccagaggtgtctctggtgacggtgaaagatccaccggcctgagactcccacacgtactgctcatcgtcattgtgcttggtagtaacaacaaccttgtcagcaaccaagtaagcagagtagaaaccaacaccaaactgtccaatcatgctaacatcagctccagcagccaacgcctccatgaattctttggttccagatcttgcaattgttccaaggttgttcaccagatctgaaaaataaaacaaaaacgtattagccaacacaccaaacacataaataatcaacgaaaaccaatacaaattgcttttgactgaaatcaattacgtaccagccttggtcatcccaataccactatcgataatcgtcaaggtgttgttagtcttgtcgggaatgatgtgaatgaagagctctggctgaccatcgagcttgctcttgtctgtcaaggactcaaacctaatcttgtccaaagcctgttttcaccagagtaaaatcacaatcgtaagtaaccaaccaatacacagaacgtatatacaaattacatataagcaaactttgtaaatctaacaagagtctgcttaatcgttggtatcaacactaaaactaatcaacagatttgaacacaaacagcttcgcaacttcaattaccaaccaaaattctaaaatcggctagaacactaaaccctaatcaatcctaaatctacagatcgaacagccagatcaatcaaacgagacagacaagtataaaataaggtgtagagagatagagatcgtacatcagaagagttactgatgagttcacgaaggaagatctccttgttagagtaaaaggtattgatgatgagggagagcaactggttgatctcagcttggaaagcaaaggtttctgcgtccgccattctcgttgatcggaaaaaaaatctaagagctagggtttatgaatcaaatcgagagataaagagagcaaaattttctttagagagcagagaagtgttgattgatacgagactttggggaaggatgttattatatatagtggtgtggggactgggaacctataagggtttctagatccttcctatttgatttatgttaatttgcttttcaggtccacataatctgcaatataattaaatggaaattacaaaatacaaaactattttttggtagaaaaatacaaaactttattaaattttttaaaattttattcccttttattttattttggagaacaggtgtaatttactactttttgtaacaggttttagtttacttctttttttttttggttaaattttgtaatttactattttattttattggttgatgataatttactatttataaaaaacagtcagatttaattctactccctttttattttgcagaacaggtgtaatttactacttttttgtaacaggttttagtttccttttttgttaattttgtaatttactattttattttattgatgataatttactattttaaaaacaaagcaataattttattttttgcttacaactttttttttcctgtttacagattggtatgtgtatcttttaataaagtttcaaaaaaatcaataattaaataataatattgaaagttgtaaaataaataaattaaaacaataacaaaaagaaacacatattctctaaaaagcgtggggtttgtggggagaaaaaattgattttttttttttaacttcagaattgattaaaactttttttttttttttaacacaactatttatcttgttgttataaattaaatacataactaaaatttgaaataaaattttgagatatcttgaaactaagggattaactttatcgatttcaaaaaataacccaaaactaggaccgatctaaaaaaatctaaacatagataaactagaatgaatgggaacttgtaaattcaaatccataacaaaatcgaattttgtatatggagaaaaacattgtttttattgattagtttagctaatagaaaaatttaacaaaaaaaaaaaaaaaaaaagtaagtagcacttgttccaaaaaaaaggaaagtaaaatattatgacaatttttatattttacaatttccattatattatgacgtctgtttccacatcccctatatattacacacttttcccccttaatcaaaccatcaatacttctctgcttctcttaagaatttgctttttgattcacataaaccctaattcttagatttttttcccgatcaacgata

SEQ ID NO: 599 - DNA, 3000 bp, Arabidopsis thaliana
agtcggagaagctcttgcggtgcgtttcgcgtttgcaatgaaggcattctcaaacacagagccattcccaggtcttgtgacattgacaaaaggatctgcgtggacatagacgttgtagagagatttcgaatgaccagagaagaatcgatcccagattggcgcgaaatggagatcggagttggtgaggaatagaaaagcaatcttgagcttagggttagggtttccagatgagagatgagaaagagaggttgatccagcagcggcgatgaataaactccggtcatcaatctcatcggagattgggattaaagattcaccaggaggagaaggaaacacatgtggcgctacaaagaagaaaacaaatgggagacataggagaagagagaagaagagaacaaactgattcgagaacatttggaaaaggaaaacaaaaatcggaaaccctagaaatttttgacttccccagaaactggaaaaaaatctaccggaatgtgattgaatctcccatggattagcagattctgaagataaagcgttgtctcgatttcacattactggagctatgagaaatagattctcatagcttttttccgacgataatacgtcgacgaacctctctcaaagactgaacgaaatcgatgaagaaatatagaaagaaactcctgaaaaacgaaggttatctatctccagaaatttgggggaaaatcagcaaagattgaaaatttatgggggaatttaatgagaatttagaaatatctttcagatctcagattgtaaaaaaaaaaaaaaattcaatcacagtcagtgatgatgagagattaagatgacggagtattgtttttaatcaatctgtgattgacgcgccactttggccgtaggggtatttacgtcaatttacaaaaccgacaagcgttataatacctgacgtcgtcaagtttattatagtaactgttttgtttatcggaacgagacggatgagttaacggcgttgcgctgtgtttaccgtcgttgataacggcgatgatacgtcggtcgataatgatgtgtgagtgctattttttattcatttgatttttatgttttttagtaataaacgtgaggatttttgtaataaattagacattgaatgttgtatctaattcggtaggtccaactgatttggtaactggtaatgcactattttgctcggatggatgttttatttctttttaaggacacgtattagattagatgtataagcttatgcttttatactcatgagtcatgactctttacaacagaaatactatggttcaattttctttggaaggagattaaacccgctttttatccccagtccatatgattacaaattataatccaaaattttctgattttcggtttatgaaggaaaaaataaaattacaatagggtattaatctgagaattacgcataaagtgcataatgctaatcgtaatttgaatggagtcaatacttcgtggtaggcgtcgtggatggtaaattttttaaaacgatgtgatatatattcaaataaagcctcataatgcttaaaaagacaaaataataacattggagaatagccttttagtattatttttttaatagaataagtgtatataataatttatattgaatgtgtgagtaatatacagcccaatgcaatcattttataatccccatgatacaaaagaaagaaaggagaattgatatagatacggtataccaaaatagatgcattgatttgaagtcaaccaaagcatattacatggaacatagtcgaaaccaagtcaaattaaaggctggatccaggaacctagaggcaaaatctacaacgagtgcttgttgttttttgtatatgtactttttttttactttgttaaaagtctttttatacgtacttacgaagttgtattagctatcataagcattggtcgtacatatcgtacgcgacacatgacgcactttggtaaaggagaatgaataagtaccccatgtgaataatgtttgaagcacttttagtaaacgggttaatatcttactcaggcccatgattaatgatttgtgtaatcattttgttttgagatattgcattactcatgcatttataaaatgatttagatcacttgaagtacttgacaaaatttgtcaattggattctctatgttgatcgggtataacatttttcagtcaggactaaattgcattcaataaattatatttcatctattccttgacaattgattttctaaaaaaatatacatattaaaagttgattataaatatattatttttgatgattaataattttctactattctaaactaatattatttaattattatttttaaaatttaaaatttatcaataataactaataaatattacatagaaaatcgaaaaattaatttttaatcaataaataacagaaataacttgattatatgcctgtctataatatttttttgtttgcagttagattatatatgttgatataatactctaaagtctgtatttaaaaagagataaaattattgtatattaattatatttggattctgattgataaaagaaaaaccttaatattttgttaactgaaaagaagagacctttaatatgttatatgtcaaacaacaatagatgaatatatgaacttcttaatgtaaatttcaaagtaatctccttttcttacaatttttaaattaaaatttccataattccatatttttagtcttttttttttccgtctatatttttagtctatcatagaagaaatttcctatttctttctcaataaaaacaaaattgagaaaaggaaaagggcaaaaagaaaaagatataaaaagttctagagtgttccgcttcacaagaccttgaacagaagcaaagtcttcaaaaccaaacaagttagcagccacaacattctccttctccttctcctcgtgaagacttttctctctgtttattttttttagggttttcgtaagaacagagcaaaaaac

SEQ ID NO: 600 - DNA, 3000 bp, Arabidopsis thaliana
tcataatcataattacatatttatatgccttaattgatatgaaattgaaagagaatacgaaattgaatggaaaagtaaaacaaaagttgtctttgcaaaaaatagagtgacaaaaaaggaaaataactgtaaacacatctacagtggttttattttaagctacacactcttaacattttctaatatgtaggcgcatgcttcagtaaagttgattaacaaaaaagtattaattgatgcaatatgttataagcattctttcactctataaattcctccaaccgatatatactgtatccaattcatagttttgtgtatattattgtttctaatgaaatttttgttttgttcatgatatctccagcatgtcaaagatcattgatcgttatgaaatacatcatgctgatgaacttaaagccttagtaagttagctacgaacatcatcaaaattctctggaatgcagtttttgatgatattatgggatagaattactggtcgagcctgagataactcaatgatttgaatttcttaaactggacttaattttcttaagtaacagttgttgcatttttagaaaaaactcaagaactttcacaatctttctgaccattgccttcgttttatccatgttcaggatcttgcagaaaaaattcggaattatcttccacacaaggagttactagaaatagtccaaaggttagcactaagacaccttttatctccctcttcttctgataaaacatacttctttttcttttggcgacttatgaatacagcaagcttgaagaatcaaatgtcgataatgtaagtgtagattctctaatatctatggaggaacagctcgagactgctctgtcagtaattagagctaagaaggtatttctactaagtgatcaaaccaattatcccaaaatcttttgattagttagattaaaaagaatagtcttctgacataatccgtaatgtcttgttctagacagaactaatgatggaggatatgaagtcacttcaagaaagggtacgtttagtgcttaatttggtttttaattgctatcaaagccatattgtagggtaatgctgattcttgaatacttttaacctccgattctgcagatctggcctttaaccaagtttaactctagatatttcttttggtcttgtcttagttccttatttgttcttggctttattttagatgaaaccctaatttgaacaacaaaaataaagcatttataaactcgtgatcatggtcagatagctttagaacttgttggaaactaatgaccttttgatcgtgtccaaacaggagaagttgctgatagaagagaaccagattctggctagccaggtgacaaaaacatctcttatgattcttcgagctaattcatcattacacttgcgtcaaaacatatatataaaaattgaaggagtttgatggaagctaggcattttttttttgtgaaaatacaaatatcttgttactatttagttggagctgtagaaaaagaaatttgaaggacttcaatgaatgcaacacagttttgagtgaaactcacaatttagttttaagcaaaagaaaagtatactcttaaaaatctagatttcttgttaatttttgttagctgtaggaaaataatgtaagaaagtttcttacaggtggggaagaagacgtttctggttatagaaggtgacagaggaatgtcacgggaaaatggctccggcaacaaagtaccggagactctttcgctgctcaagtaatcaccatcatcaacggctgagctttcaccataaacttactcacagcctgattcagaagcttttacaaaattgtaaattataaaaagctgcataataatctcaacctttttatcttcctcgcgccaatgtggaaataaaggtaaaacaaaacgaagctcttttcttttatgcgaaagaattgtaaaactaagataaagctaccgatctttgttgtaccttagtagacaaatatcagagttcttgtgcttgtcttctttgtctaaaagtacggattggattcaaaagatttgctttctttagcgcgaagaaccctagagcttcttaattcctttggttttccttatttaattgttagtgtttgattacttgtcgtacgttgagtggcttacttatttagttttaatttgcttcaaccgtactgtccgtatcagatatttggtcattttccaagtttatcatcaattctacttttgaggtaccaaaaatagttctctcagaaagaatatggcagaaaaagacttgtcgaggctggttaggactgcgtccagcttcggcccatcgaggcccataatttaaatatggtggcccatagtataatgtatttcagtttaactcggttcaaatttttggatttttggaaaacacactcggtcaaattttcagattggtttgaaatttggttcggctttggatgatcaattctatttttgggtcggtcggtttagagtccaatcaaaacgggcttaccggttatctttcagggtcacaaccataacccaaataaaccgatgatccggacaaatgataagtcacgagctgaaatgacgactcagctcgaaagatatttatttacgagcatcacgaaagtagaacatttgtcgaatcgatttgttggatattgatattacgtggaactatcttacaccatttttattattaaccaagggataataacaaagaccaacgcgccacaagggaactcgacatgcgttaatacgtgtctaaactcctattaaaaacgcaccgtttagactctttgagtttgtggttttggtttaagcgagaattttttcttttcctctcttattaacaaaacaaaaacaattttaacttttttgaaatttttagcaaaataaaaagaaaattaaaaaaaaaagacacaaaaaaaacgttcagtgtctccggcgagttatgcagacatcacaatcaaattaggtcagaagaattagtcggagaaaacagcc

SEQ ID NO: 601 - DNA, 3000 bp, Arabidopsis thaliana
tttggatattcttatcctgtacttccttgatagtttcagttaacagtttgtaattaacacatgtatttaatttggaaacaaaaaaatgaatgtatagatgattttttttttgaattgttggtaaatatatgaacttgacgtatatagcaatagtatactatatttaagcaactgaatgtgaatattctataacacaagtaatatcaattttttgtgatattgttggttataagttatattcgaatttgtcatttataagaaaactcactggtttatccatccaatgaaaagaagaaagctttttgggtgactctaataaatattagcggttaaataactacaaacacagtgttgtttttgtctcttctatgtatctttttatgtcctcttttacaacttggctttgatgttaactaatcaaagattatcctacttaaaaactatttaattaaataatttttaatttctttaaaattaattaatttcttgatatgtttttgtaacgccaattaattatacgtttttcataatgtggtgtttgacttatggtttgaatgttaagatgtcgtatatatctaaattctaaagaaagaaatttgcaaattttgtaataaacactatttttacaacaattaataatacatgtgccaagcagaagaacgactatattagttttctatgtcaacatttaagaaacatttatttaaaatttgaatatttgattttgtatgtcagcaatgtttaagaaaactttgattttttgttttccttcttttgcgtacatattaaatggaatttaatagaaaaccattaaatcttgatataattaacttcttcgcccttgcagttactaacaaggagacttttgttttggtactttctcgattagtttagtgaccgaccaacaacgtattttaaaactcaaaacacaatctctttcacgtactgtgcgaagtgcaagtcgaataatgacatcagtccatttgtgttgtattacacgggactacgatctctattctactatatataattactattaattaaaatgtttatatagttatgatatggttgatagtaatttaatagtaattgttaaacagtagagaagtgacactgagacatatctgagaaaagcctgaactcaactcctacttctggtttgatttcttgggattcgttctctttcatttacttacctctccatctatacaccaacatatatatatatatattggtatgttaattctccaaaaaaaaaaaaaactattttaggagcaaaactttttcacagttattcattttttaagttaacttaacttctcttctttgtttgaaaattcatttatcatcaaataattctgttataaattagacctgataataattctttaacaaagaaaatatattttaggagcaaaataggcagagccgcagaggcatacatgtattatatataacgattatttatgtatagaaagggacaccttttgtacaaaatactagttaaatttgtacattcacgtgactggttggctaaatttagaatattattattttcaattaaaaatcatcgtcaatgttcaaatattgcttgagatacgctatgcttcataaaaatgtttaaaaagtagttccaaaaaatattttcaccaaaaaaaaaagtagttccaaaaatattcatttaataacaaaatttgcctacataagcttagcaaacgacactaacaccaaaattgatatcattttcttagataacatattgtatacatatctacatacatactaaatacatatacacgtagattacacgtatggattcagcaataaaaatcaaaatactaaatacatatatacatatatatatatatatatgaacatttaaatactaaattatgtttaataaataattaaatcaacgtagagatatgtcatatgaagatggcttgtataattagtttgtgtaccgggcaaaggatctctaatttttgttttctttagttcagtttaattatttgttatctatccaatcaattttttttctaaactgtttggaccaatgtacgtacgtaccatcctttttgattttttttgtaaactaaattttcgaattagcaggttcttaataattgaacgaagaaaataaagaatagaggtagacacctgtagtattttcttggtcagaccaataatttataattcaacgtcaaagaagaagaaaaatataaaccattatttcattatgacttacgtataccaaaatacacaaattaaatgtataattgtgaggcattttatatgcgggaaaaaataaaataaaaagaatattaatatttcttttgaaaattgtaaagcattttgacccacttgtgatatatatatatatatagatatatatagagagagagattaaaacattgatggctagctatagagtctatggcagggtcatgatcacctgtcttctgatctctgaagagataccaatctgattttttctcttcctaggtttaattttattttaccattttataattctttatttttgcctgtagtacaatttacagacccatactaaaagaaaaattaaattttgtcaaagtacaaaacaaagagagaggtgaagccacacaatctcttttcttctctctctctctgttatatctcttctgtttaattcttttattcttcttcgtctatcttctcctataatctcttctctctccctcttcacctaaagaataagaagaaaaataattcacatctttatgcaaactactttcttgtagggttttaggagctatctctattgtcttggttctgatacaaagttttgtaattttcatggtatgagaagatttgcctttctattttgtttattggttctttttaactttttcttggagatgggttcttgtagatcttaatgaaacttctgtttttgtcccaaaaagagttttcttttttcttctcttctttttgggttttcaattcttgagagac

SEQ ID NO: 602 - DNA, 3000 bp, Arabidopsis thaliana
aatcggatatgctcttgtacctatgattgcaaggggtatcatgcttggtgctgaccaacctgttatcctccacatgttggatattcctccagctgctgaagctttgaacggtgttaagatggagttgatcgatgctgctttccctcttcttaaaggtagttaagggttttgttttgctgtggatatttgcattccgtgtcataagttgttttgtataagtgggaaaggagaagatgaatatttgatgtgtattattatcaggtgttgttgctacaactgatgccgttgagggatgtactggagtcaatgttgctgttatggttggtggtttcccgaggaaagaaggtatggagaggaaggatgtgatgtccaagaatgtttccatctacaagtctcaggctgctgccttggagaagcatgccgctcctaactgcaaggtgatacgatctgtttgctttttaagttaaatgaagccactgcatccaatcttctctgttcattggagtgtaacagatgctttgtgttctctattgggttctagtttacgactctcttgctcacacattcgctctcgttttgtcttttttttttcaggttcttgttgtggccaacccggcaaacaccaacgcattgatcctcaaggaatttgcaccatcaatccctgaaaagaacatctcttgtttgacaaggcttgaccacaacagggctttgggacagatctctgagaggttgagcgtgccagtgtctgatgttaagaacgtgatcatctggggaaaccactcatcctcacagtacccagatgtcaaccatgctaaagtgcagacctcgtctggagagaagcctgtccgtgagctcgtcaaggacgatgcatggtatgtataacatgccatagaacttaagaccctttctcttctctggaagcaaaatctagtttcacttaaatatattgctcattctgtaggttggacggagaatttatctctacagttcaacaacgtggagctgcaatcatcaaggcgaggaagttgtctagtgcgctctctgctgctagctctgcttgtgaccacatccgtgactgggtccttggaactccagaggttcataataaaactcttccccgttatttgcagtgctgtttttttgtaacagttaatctaatatgagttctttctttgattcaaattgtcagggtacgttcgtttccatgggagtatactccgatggctcttacagcgttccatcaggacttatctactccttccctgtaacttgtcgcaatggagactggagtattgtccaaggtaaatatgacgcacttacaaactcaaatgctcatcaattatgaaatcctagattctgcagaccctaatgtgtattttgtttggttaggccttccgattgatgaagtatcaaggaagaagatggatttgactgcagaggagctcaaggaagagaaggacttggcgtactcatgcctctcttaaacccttctggagcaaaattttcatctataaggtgtgagatcagttaaagcctttcagggctttgtccgaataagaagtgtgtttgaaagatctccaaacactgttttataacctctttggtctctttgatgagtattgtccctggtctgtttctaaaccaggatatcgtttttttcaatgtgtctgatttggtttacccatgaaaagaagaaaattggcagttgcatggttatcttttgcgattatttttttctgctttagcaattagcccaaaattgatgagctcttcgataatgggtttgtgcaattgtgatttgtgaggaatggtgttattgtgttgcaattgcaaaaagaaatgctactcttgcagattcataccaaaaccaaatcactagattaaactgaaattctaatgtggattattttaattttacttctatttttcttcacccaaatattttataaccaaacaccaagttgacaccaaaatatacatccaaaaaacttagattgcttctattttacgactatccgaaatcgaatcataaaccgtaggcaatggtccattaataaggggtatacgaggattcaaagtttgagagaacttttttatctttacctttttccttttgtaaagtaaaagcagtggattttgattatagattctacttggtaatgactaatgagaatcaagttctcacctttaagccatatagactttagatatttaatggattctacaaaagtgggcatgaccagaatcgagttcatgaaccaccgtcctcggccccaacgttaaaaaacttttttctctagcataagaagataagagtatcttcactgcgctttaggcccactcaacattcaaacaaaattcgatctcttataaaaaaatatctcacaagagaaagttcgtacatgatcccgataaaatcgtagatgagcaaatcaaagatgagatgtcggtaaaaaaaacgctattataagaacacacgccactagttgtggataaagttgtctacttttgtctcgttgtgattattatattgcacaattattaacattcatactctcatatgggtattgtttttggtctccgttagatctcaaatctttaactttgcatacccaaaataggaagaaagaagagtcaagtcactaaaataactttcacagtctttgattcgaagatctttgtcgccgagagatatccactctgatttgagttctggtaaaaagtttccagcttttgatttttgtttctctcaattgaatttctcttgcttgctctgtttaaaaggattaggattaaatcgaatctctctctgttatgtttttttgtagattattttggattttaggactcaaagattacagatttcttatcaatcattctctgttattgttatagaactattctctggaggaggttgaggtctgaaatcatggaacaacttggttagagtgtggaattttagctgatttgatctttgattcatctgtgatcataataact

SEQ ID NO: 603 - DNA, 3000 bp, Arabidopsis thaliana
atggtatatatccttaatgagatccaaggaagagagaattaacgtcccagacacctccagcacccacataatccatggactctacgtccacttttagtctttctatccattttcgttcgatggtcggtttactagttttgaaaaaaacctttaaaacttatttattggataattattaaaaacaaaatataaaatttattggctcatgatttttgcaaaaaaattctctatgttttgttctcatttctcatttatacgatattaaaaattacttttcaatatgtcggccatcattaaattgcttcactctaatcccgtggccgtaaacgtttttctttcaagctagactccataacaactacgtgcatttaatttctcaagtataaaattttcatgttttcaaatagtacgatgtatttagtgattttatttatgtactttgttcattaaattagtcataattgttctgatttttaggggttttgatcgaacccttagatcaaaagttaccttaattgtttttttagctaagtactttattaaaaatttaatgtttagttctgattgagtagtactataaaggagacatgtgtcaatcttgtcaattggttttgagttcaacaatatgcaatattgcacatgcattaacgaccaaaagaagatgcaatgcacttaaatcattgaaactgattttgtttttgtagtgtataaaatatctatttaattaccaacgaaagaagtgagcttttaaaaacaaagagtcagaagatatatataactacaaaacctacagaagataagctggatttcaaaagaagagaaagagtaaaccaataaattgaccaaagcaaaatcggatatttgacataagtttccattcacattgacccaaatccaccagcatttcaaataaagttacttaatataatttttgtgtttataatatattccgcccactcttgccttcatttggaccttatcctaaaagtcaaaacaggtgaaaaaaatgagaatacaattaacacgaaaaatgcaaaagactgttaaaccgaaatcgaattctagtgtaatcaatccttttcccaatgatacaactataaatcaaaaagaaaaaatgtactgataaacgaaactaaacgtataaattaatatatttcttgacataaataggaggcttttgcctgctagtctgctacgatggaaggaaaaatgcatgcacacatgacacatgcaaaatgtttcaatgaagacgcattgcccaattaaccaacacaccacttcttccattccacccatattatttatttctaccattttctttaatttattgttttttctttgattcatacactgtttatgactattacattttccctttcgactaatattaacgcgtttaaaccaaagaatggatttgataatgaaattttattttattagcatatagataatggatggcttcatgcttggtttccatgacaaggaatgacacaagataattattttgaataaaatcataaatatgataatactagttgtaaaaaaacttgagtgtttcgtgtgttatttttcggtttcttgactttttatatttctcgtttttgtaattttaggatggattatttagcttgcttttctcttttattactttctaaaattttatttataaactcatttttaatatattgacaatcaataaatgagttatcttttaattaataaaaaatttgtaaactcttgtaaacagatcatagtcactaaaagctattataagttatttgtagctatatttttttatttcatgaacttaggataagatacgaaaatggaggttatatttacataaatgtcaccacattgcctttgtcatgcaaacggcgtgttgcgtcactcgcctcctattgggaatcttataatcgcgtgaatattattagagtttgcgatatttccacgtaatagttatctttcacaaattttatactcaattacaaaatcaacgaaaatgtacatttgtatctttaactatttacgttttttttacgtatcaactttcagttatatgttttggataatatatttttttacttttgacttttcagttttcacctaatgattgggatatacatatgcatgcatagttcccattatttaaatgtaagctaagtgcatatgaactgttagtcaaaattacgaagtttatttgtacatatatatagttataacaaaatggtacagtaaattaaacagaacatcaagaaagtacaaaagactgaacacaataatttacatgaaaacaaaacacttaaaaaatcatccgataaaatcgaaatgatatcccaaatgacaaaaataacaatatagaaaatacaaaaacaaaaacaaaatatgaaagagtgttatggtggggacgttaattgactcaattacgttcatacattatacacacctactcccatcacaatgaaacgctttactccaaaaaaaaaaaaaaaaccactcttcaaaaaatctcgtagtctcaccaaccgcgaaatgcaactatcgtcagccaccagccacgaccacttttaccaccgtgacgttgacgaaaaccaaagaaattcaccaccgtgttaaaatcaaattaaaaataactctctttttgcgacttaaaccaaatccacgaattataatctccaccactaaaatccatcactcactctccatctaacggtcatcattaattctcaaccaactccttctttctcactaattttcattttttctataatctttatatggaagaaaaaaagaaactagctatctctatacgcttacctaccaacaaacactaccaccttatttaaaccacccttcattcatctaattttcctcaggaacaaatacaattccttaaccaacaatattacaaataagctcctatcttctttctttcttttagagatcttgtaatctcctcttagttaatcttctattgtaaaactaagatcaaaagtctaa

SEQ ID NO: 604 - DNA, 3000 bp, Arabidopsis thaliana
tgggagaaaatttaggggcacgagctttgcagtcacctatcaattaatccattaatctaactagtctatacacgttatccgatgaagaagtgtaaaatgttggaattgccgagttaaaataaaagataattaccttccaacacttgcaagggcactaatatgcaaatgctcaggttcttcttctctttagaccaacaaactcattttgcttaaacacttctacttcttttcctagtttatctgcagtttcctgcatcctcttctgagactcagccatttctccagccacttccctgcaacttgctccaaattttaatgtctcagcttcacaacaaaccatctccttctctgtttcaagtaaagttttcctgagatgactagttttctcatgaagtaaccttagtcgcctgtacgaagccataaattcactcaacatttgtacatgtttccctgaaatactctccaattgaagcttctctgagttgtactgatcaattaggttctgcaagcaagggaatgaccactcagctccatcaatttcaggttgctcatggtttgtccttccatgtatcacaacagaaccactagagaccgtatctctgatcaaatcactcatcgcttcatccacactcaacttagaaagagcactatttgttggctgatcaccattctgagtctttttccatggctcttcaggttcgctcgtaaccggatcaaacagagagatacctagtaaatagcataagagttcaaagaacaaaaaagtgtattccaagcataatactttaatagaatcaaaattgtccataagtgaagtaccttggttcagagcagtagagtgtacatcagaaacagacattgaaatggaatccaaattttctaatgtagaatcatcctctgcactaacagaatcttgacattctactacacaatcatcctctataccactaacagaagcttgacattctttctctgatgccatttggtttgcaatttccggtataacaccaccacgagcctgtaagctactctcaacatcactcaaaatttgatcagcttcaacccaaaaatcaatctcatccataacatcacaactaggaatcatctcaacatcttcccacttgaagaatccacaagctccaaatccctaacacaatttcttaaaacaatgttaaccagaattatcaactatgagctttaaacttgcgaacgagtcaaaacctttttgatgcagcatatcaggtaagctctaccggaaacgtctttaactctccggcaaggtccagcaccgcaggaacaaatcgggatggtgaaggcaggacggaatttgatatcttcgtcggttactttgtcacaccatttgaagaaacagcaattctgagcctgcgaatttcaaatgtcgtcagtaacaaattcaaatttcctcgcgaattttgcaggagatgaagaatcagtaaagaaagcgagtacgaaccgttggacacttgtagaacttccttccgggattttctcgagtattcgcgaccttgatttcacagaaacctccgccgcatgggcattggatcgccggtggaggatcatcggtgtaggatttgagaggacaatcgttgatccagtggccagcctgacggcatcggaagcaatctccggtctgcattgtgccgttaagcattcgtcgaacattctccttctcgggatgttaatatgggccaggtcatcttttttaagcccacataatttatttttagctatgactgaacaaaacatgctgaatatgggacgggcttaatgggcctgaagactttaagcagattaacgaaacaagtgtgttgtgtataatatgagaaccatgtcgttctgatcggttaaaaactacagctgaccaaataacatctataggcttctgcggatatgactctacggcgtctacgcctcgcatgcctatcatatttaaccgtcaataatggatttggcggttttggtaggccgggtcaaccggattaaaagaaaacggtttggagtccttccttgcaattgaattttcacacattcgggttttgtgatttctctgtcataatgggcccggcacatatggttcataacccatgtgggcctatggtataatttttccaattaaaactattgttaggtcgataaaacaaaaaacaataaaaacgagtggaatacacataccaaaaagaatgtgatgaacattagtaattttattttgatggttaatgaaaaacaaaataaatgcatcttggcatcttccgttggaaagcgcaaatagggcagattttcagacagatatcactatgatggggggtgagagaaagaaaacgaggcgtacctaatgtaacactacttaattagtcgttagttataggactttttttttgtttgggcctagttataggatcataaggtaaaaatgaagaatgaatattagattagtaggagctaatgatggagttaagtatgcacgtgtaagaactgggaagtgaaacctcctgtatggtgaagaaactatacaacaaagccctttgttggtgtatacgtattaatttttattcttttatcacaagcgatacgtatcttaagacataataaatatatatcttactcataataaatatcttaagatatatatacagtatacacctgtatatatataataaataggcatatagtagaaattaatatgagttgttgttgttgcaaatatataaatcaatcaaaagatttaaaacccaccattcaatcttggtaagtaacgaaaaaaaagggaagcaagaagaaccacagaaaagggggctaacaactagacacgtagatcttcatctgcccgtccatctaacctaccacactctcatcttctttttcccgtgtcagtttgttatataagctctcactctccggtatatttccaaatacacctaacttgtttagtacacaacagcaacatcaaactctaataaacccaagttggtgtatactata

SEQ ID NO: 605 - DNA, 3000 bp, Arabidopsis thaliana
tgatttgcctgaatgaaaataatttattatacacagaaatgtatttgatttcaaaattcaatttatgtgacctgaatgacaacaaaattcccgaaaacaaaaccaaaccatgagatgttttaaccgttctaagttttgtaacccagccggagcatgtccaatgctccaccttgttgaaaagatatattaatatcatttttttgggccaccttttttactgcaaattaacaattgtttggctatatactccaaaatatgaaaaacaatagttgttttaactacttacaaatttgaggtaactccatgtattagctattaggaggtcaaattattcaaaattataactcaaattttcacgtttgcaaattaattcctcaagttttcgctaccacgcaacatcatgctaaaaatagtcaacgttaacttctacgttttcttatttggcgttgacttttttcaattgtatagtcaatttaaacttcaaaaatttaatgtgcgcacacacagttgagaaattaataagtcaattgcaaatatttaaggaataatgaataatttccctatctatttggtggtttaatctccaacttatcttttggagaatcttgtttcacagttattaactttcactaaaacaaatgagttctttctaaaataaccttttaagttgtaacctaattatagtcatatacacatacaaaaaatctacaaaattctatattcatatacacgacttttgctttctttcttctctaaaaccatcatctttttgtgtagtgaatttgagtgaaattaactttgatacgtcaaaaataattttatttttattcttgagaatttgctaatcttgccattaaaagtatttttgggatatctaaaaactaaaaaaatgaagaatctaaaataatatttgttctacaatatagagtaatctctttttcataacatcttttacaaagaagttacaagcaaaacttgaaataaatatgtggaacagcgttatcaaaatacatggaatgcttatgatgtttgctacataataatttttgtttgttacacattacttgatgttttcatttttcaatgcaaaattaattattttatttgtttttaatcatttatattctgcgctttgttgtctaaatagtttttaattaaaaaacattatgttttaattttgtttttaaaaaaaaacacaattggtttcttaatctatttaatcatcactaatattgaaacttaagaagtaatgttaaaacaaagtagccctatagggtttttatagaaattaatgtaccgttaagtaatagatttcagacatcattgactatcaaaaactaaattttcggacaaaaagaatttcattactattttaaatttgttgatgttaaagagaatagattggctgaagtgattgatgttaagctgaaaaacaatcacaaccatggaaaagtcacatcagcggcaagactggctagtagttgtgtgaggatgaaaggtaaaaaatggccaacaatggcgaagtggctgtcgaattggagcacattcgctcattagcgtagtcgcgtttttttttgtatttttttttttgaagaaaagtaaacaggacctagtgtgactgtgtgaggtcattgattcatgctgatcttcaagaccgatcgaagtgtagcaaacaatcatcctgcatgcaggcatctggttccttgagcagtctccatagctttgatttgcgtttgctcttgatttcaatctattttcacttattatactttaaaagaccttgaaaactcgaaaccaggaatattgaactgatcagatcctggaccactgcaataactgagttcatgtacgtacaaaactaatatgtcacgactaggaatttagcgtcctcgtgagattgagagagacacgtatggtgtcaattgcccgaaggtacagtattagtttgaattgggcaacaacaacaaaaacgtgcgttctctaatactcacttctctagaaaacaacaaatatgataacgtaacctcctttgcttcttttcttattaattaagaccactcgtaactaataaagatgatagatcttttatataaaaaattgtattcgtcaatgctcttttatgaaaacaatagttcaactacccatacttgcatctattagctatctagtattctcatattattacaaacattatgcagattggagataattaccaacatttctatataaacaatccgaatttggtgattataaatacttaattaccattctggaagtaacaatataacaggtagtatctatgttattttggcatgaaaggaaatgatcttaacttctcaaagtatatttcccacttttctcaagaagatcattaataaactaatacctcttcttggacagacatttttgagttatcttgtttttgtttcggtcactagttaagaaaagagaagaaaactcaacataccattttatcacgttatagccatgttcgaattgaaaactaaccacctaaaactagaggatatgatttcttatctattttttggtttcattttaagcaggaccaaaacctaaatggccggttcctccaaaactagttatattttttttttgtataattgcaaattcataaagatgaaaagagctgcattcttgggtatatacatgttaacatatctttctttagatacagtggtcctcctatgcatcacatgcaatatcgggtaaggtcaaaaagatattgaattgtccacaacacataagaagttaagatgtcactcgtggacattaacgtcgtagagtacccatatattcccatggaaattattggtattcgtaactcttggatatttttaaacgttgttaatactttaataaaatatattatattgtctaccgaatcaaacacagctgtatcaacaaaaataatttgaaacttgtataaatagatgaagtggatatgagaggaatgtaagccttatagaagagaaaaaaaat

SEQ ID NO: 606 - DNA, 3000 bp, Arabidopsis thaliana
ctagaaatcaactgagacgatgtcacatggattggcgatgaacacataccagatctacatggaactctgtttttaagattacgattcaagtcagatcaaccagagagacaaacaaaccaagtaatgactaatgatccatattattaagattctaatcaactgataaaattttgaatcagcttagagtttcatactaaaaccagctacacaaaaatgcggaaacttgaaaatgaatcagaaatcaagtttttcattaatcaaccttacgcaagagaaagactaagcgtcgtccacatatcggattcatagacgcatcactagataacgaaatatagggttcgaattacgcagctgagagtttgttttagtatgaatttacctgaagagagggatctggaataagatcaagacgaagtaaaccgatgaagccatagacgtccatttctttatccatccctttgattgccctgggttcgccattaacaagcccgcaaagaaatcaaatctagagagagagagagagatgcagagtggacccgttgttaccagacgataacgacgaagaacaaaataaatactttataaacgacacgctttgctacactgtaaacacaaaacggagtcagtgtttagatctttaagggataaacgacgtcgtttacaaagattcatataaaaatccgattatttttctcactgctgctgaaaacagcaaacagttttgatgataaaagccatggctctatcttctgccggcgtcgtctctcatcttcatcctccgtcgttttcttcgtcgtcaggattatccgtcaacagagttctgtttcggaatcggaacgctagtccttgtggtctatctcttccaattctcaatccgtctcggtctgtacttgtttttgctcgtggcaagaatcgaaaaggattcgtgtcttcgtcttcttcgtctccgaagaaaaacaaaaaggtaagaaaatcagaatgagaatgatttatgttcgcaattgctcttacctgctgctttcgccgaatttgactagaatttggatacactaactaagtgagctattatcggttagaattggtgaatcctcgaattagactttggctctttttgattttgtatcagcctttgatttcatggtttgtggcagaaaagtttggatggagctgataatggaggaggtgaggaggaggaggatccatttgaggcattgtttaatcttttagaagaagatttgaagaatgataactcggatgatgaggagataagtgaggaagagttagaggcattagccgatgagttagctcgagcattgggtgttggtgacgatgttgatgacatcgacttgtttggttcagtcactggtgatgttgatgttgatgttgataatgatgatgatgataatgatgatgatgataatgatgatgatgatgatgacagcgaagaagatgaaagaccgactaagctgaagaattggcagcttaaaagactggcttatgcattgaaagctgggcgtcgtaaaactagtgtaagttttagttcagtgttgaagtgatgttgaatacattgtgtaaagcatagtgcttgagttagtgtctgctttggagattttgcttacgaattgtttaagagttgacaaagaacaagtagttctctggttttcaaatgcataattgataacggatggttttgttgtgatctgtagattaaaaatctggcagctgaggtttgtcttgacagggcttatgttcttgaattgcttcgtgacccgcctccaaagctgctaatgctaagtgctacactaccagatgaaaaaccgccagtagcagcacctgagaactcctcacctgatccaagtcctgtggaatcattatcagctgaagatgttgtggtcgaacctaaggaaaaagtaaaagatgaagcagttcatgtgatgcaacagagatggtctgctcagaaaagagtgaagaaagctcacattgaaacgctagagaaagtttacagaagatcaaaacgacccactgtaaggattctccttttacatttgaatcaatttctatgttacttgaatgctctatctcacatatgatcatgtttgatgatgctgtgaatagaatgctgtggttagcagcattgttcaagtgaccaatcttccaaggaagcgagttttgaagtggttcgaagataaaagagcagaagacggagttccagataagcgagctccatatcaagctccggtttgatctaatgttaacgttgagatggcaatgatttgtatacttgattctcagaaactcatcaacattgtcgtcaaggacaagtttttttggtgatacgaggagtgtttatagtagtagattctgtccaatggtgtggctggatatgttggactatgaaattttaggatatcttgtattcagtttttagttatttccttgctgagattgtgtcttgtagaaaaccgtttcaactttgtttggtttatggcggctataaagtttaattttaatgcatgacaaaaacaaatcaccaaaaataaaataaattactttcacgacacttttgaaagcactgccctaggcgtgggccatgtgacagaatgaaagaactcagaccaaacttttctgtccaaggacaggaatggggcccacccaattagctcccctatccattattcaccgtaagatgctaaccagatctaacggctaaaatccacccacgttccaatctcaattgcctttggatccttgtatttcctcaaggctcacctttctccacgattcactctcgatatccgttcgattcttcagagatctgacggcggtagccagagtaatctattccttcccaaaatgtctcgcaattagattctttccaagttcttctgtaaatcccaagtcccgctcttttcctctttatccttttcaccagcttcgctactaagacaacaaatctttccctctctctctcgcctgatcgatcttcaaagagtaagaaaa

SEQ ID NO: 607 - DNA, 3000 bp, Arabidopsis thaliana
tgtccactgttacaagcccatttccctgcaatgatcctcctagcagccaccttcaaccacaacaccacaattagagtatgagacctgaatttaactattttatgctttagaagcagagaaagatcttaacttgtagattaacatctgaatcaacaagagctgggcacttcccaccaagttcgagaaccactggagtaagatttctcgcagccgcagccattataatgcgagcaactcttgctccacctaaagaaatactttaaactatttaaaataatgttttcctgagatcctaatcaacatttcaaagattcttgaaagaaaaggagagaggacaaaccagtgaaaaagatcttgtcccatttttgatccagtagtgccgttgtttcagggactcctccctcgataactctgattgttgtattgtccaagtattcactaaacaactttgctaaaagagaagatgctgctggagcaatttcagaaggttttagcacaaccgcattaccagctgcaatagctccaatgactggctcgacagacaatactaaggaaaaaaacaaagcaccatgaagacatataaactttaatagtttagaaattgagacaaaattgtcaataaataaaattgagcttacagaaagggaaattccaggctgaaataaccaaaacaactccaagcggttctgagactatttgtgcagacgagggaaatgttgtcacagaagttttgacctgaaaggtccaagcatagaaaaagcaagtggttttagaaaggacacatatcaatgaagcagcaaagcttgaacggtctagttaccgtttctggagccatccagttctttaactctttgattgcaagcatacaggatgattttgtattcgaaatctaaaaaacgagaaaaataccaaagagattcaacagtggataagtggaatgcagtgaagaaacgggacattgaaattatataaaaaacctcagctagaaaagcttcaagctcaggcttagaaagatcttgatacaaagcttcggtgatgcatttctccttctcatcaatcatcctagcaatgttttgaagctgagaaattctccactcgtagctcttcgttctgccagagttgaagttgcttctgagctcatctacaagcaaagctgcttcttttccactaaagtctgatgcttgctcctttaccacagcagatagtgttgcataacaagtactgattcaagacaccaaaaccgcaatgtgagagactttaagactaaaaatcatggataagactaaaaaaacatggataagtatcaactgttctcacgattatttattcataccactgtacttaaacttaaaacccactatactaaatagaaaggtaatcatcaaaaaatcagtatgtaaaaaccacttttgtgaataaaatatgtaaaatgggtgaataaagaaatgtgcttacaatttcaaccgataagggatacaagcattgctgcaatatccaccaccaccacgacgagatatccgaaaaggtgaagttgcaacatttaatctgcaacaaaagaggccattcattaaaatggtactaattagatctaatcatatcatattgaatgaccaaatcattcacagaagcatccattgctccaattaacattctagaccaaattcaacttaaaggtaactcttttatacaggaaaccgagaaaccgaaaacgcaattcacataaaaaggaaggcttgtttggagaagcagaatcgaacaagtcaatctcaaaccctgatgagcaggtttttcaagttacctggcaggagaaaaacccttggcaaaacaaagggtttgaatatgattaatctctagaagcttcgtcatgacttgggttcagttaaaaatctcaaattggagacattattggtgtttatatatttgagagagagagccagagaggagacgttgaattgaatgaagggtgtggtcggaagagaagacgtgtagaagagacgagacaagtaaatttaagcattggccccatttacagccacaagtccgctacaacaaattatttccaagaaactctgagataacgtcgtgatgaaacggctcatgctgctgttgtgattcgtgaattagaggtttatcttttgggtttttgaatgttacttaattggacggtcgatttttcaaactgggtgtgaaatgtgaatgggtcattcataatgggcttttgttttaatgtgaagccattcacacactctttgtccttcttttctattattcataactgtcactctttgttcttcgaaatagtaaagagcaaatcgattctttgttgatctgggccgtaaaatttccatggttgtgggaagtattctcgcagctgatctgggccgtcaatgctacagtttcatgtcagagagaggtcaagaatcaacacgtggccaaccatgattttaaaccaaagcaaacacacgattagaccccacattgtttgttcaccaacccccgtggaccctcctttagccgacgtgtccacgtcaatagtggtttttcttcctttcaaagtacacaaattccattctttctcattttactttttggattacgttgttgttataaactggtaaaatgaattatgaatgcaaataaatttcatttaagttttgttggcttctaatatttttttcacctaaaattctaataaactacacagccatgagccatcgtatgaaaagaagaagaaaaaaaatgtctttttctagaaggatctttcaacgactaaaaaagattttaagcttttgactaattttgtcaataatatacacaaatttacactcaattatagccatcaaatgtgtgctatgcagaaacaccaattatttcatcacacatacgcatacgttacgtttccaactttctctatatatatatatagtaatacacacacataaacagcaaaagcgtgaaagcagcagatcaagataagaaagaagaaagaatcatcaaaaa

SEQ ID NO: 608 - DNA, 3000 bp, Arabidopsis thaliana
cgacgattttgaagccgaaaccatccttgtaaactccaaaatagcatcctggatctctttctgtctcttatgaaacccaataaattcttcatgcaaggccttgtggtacttttctatcgcgatcaaacgtgactcaatcctactggtagtcattcctcaagttcttatttgcaggtagttaacaatcacggtcacacagaaccccacgaaaagctctctttattgcaagactcaaagaaacccaaaacgtataaaactcaaagctctctctagcttgtatgagtctcataatcgagaccctatctttatttatactaaaacgtaaaagcaaagcactctactaataggaaaaaaaaaaaaatgccaaaatggaaactctttgaagtttgaggaaaaaaaaaactcttaataatttcctaaaaagaaaaagaaaatcttaaaaaagtaaggaatacatattgttacttggtcaagtcggtgtacttgatagttggtaaaatacatgatccacaatttggctaagcttcaaaaatgtgcttttggtgatggtttattcaggttcatatctggtgattcgcgtgaaccaaggtcatggtttggtcctaacggtcagtacattcgagagcttccttgtccaacttgtaggggaagaggttatacttcatgttcaaattgcggaatcgagaggtcgcgattagactgccctcaatgcaaaggaaaggtacttaaaagtattaaattactttaaacttttgagtaacaaaagtctttccttgttatagaaactttgcttaaatttgtgtagggcataatgacttgtctcagatgtttgggggattgtgtcatatgggaagaatcaatcgatgaacgaccttgggagaaagctagatccaggtagtgttgttattcaagagttgaagtcttaattctgtttaatgtttgactaataaacctcatttttttctgccacagttctccatttagagtaaaggaggatgatgaggttgataatttagagataaagttcagtaaaaggcgaaaatcgaagcggatttatcagtcaccaactcctgaagttggacaaaagatcagccgatctctaaaagttagtttcattcatatacacttcatgttattctactctctccatgggaaattgtcatagtcagtccaaattatggtttttatagagtctcaatgccaaaactggactttttagtaagcgcatgaagattatacatcgtgatccagtgcttcatgctcaaagagtagctgcaattaaggtctgtaatctactccattttgttttatatcctaaattaacatggaacaagttttgttgtttttttcccttgaatctgcttagtgttgttgtgttctagaaagctaaaggaacaccagctgctagaaagcatgcatccgaatctatgaaagctttcttcagtaaccctgtaaaccgtgaacagagaagcctatctatgaaaggtaagtctcagtttcttggtagaatttcagagtttaggtccatgtagtactcttttgtttcttgagctttatctgtttacattctccaataatgtgagatcactgtgatgaattaggttgaggcttgtcacttaaagttgagatataatgttgattcgaagtgtagaaatgtaggtttcgatttgatttccttttgtggtgacagttccatgtgcaagctatgaaatggtaaaagaaccatttttctctcattgattcaggaactaagttttactgcaagaactgtggacaggaaggccatagacgccattactgtccagaactaggcactaatgcggacagaaaatttagatgtcggggttgcggcgggaaaggccacaaccgtagaacttgtcctaagtcgaaatcaatagtcactaaaggcatttccactaggtatcacaaatgtggaatatgcggtgagagaggtcacaacagcagaacatgccggaagccgaccggagtgaatcctagttgcagtggtgaaaattccggggaagatggtgttggtaaaataacgtatgcttgtgggttctgcaagaaaatgggacataatgtaagaacctgtccaagtaaacaagtttcagacagtgattcttgtttagagcaagaaggttcttgaacctgtttatttggttaggcttggttttgctattgaagctgaaataaccaatcactgacaagtcctttttagcggatggatatttcgggtttataatcggaccaatcacttgagtcccgattggtcttttttgaactatctaaactcaaacaaaaactgaagtgagtttgaccgcttttggtttcgggttatgaccgcattcgtttacgtgcaagtatatatacttgttgggttgatttttcttgaatacgacctgaattggtacaacggacccatgcaaagaaagacaatcgagcctagaaatttctgaacaattatcgacttatccatataaatgctataaacacctaatatctcatccatatccacatttaacactttgttttttctaacattagtatgctactattcttcgatgccttaatatcggatggttattattaggtagttatatttagtctgaacactaaattttataatcattacccaaaaagtaattagtcacgttttttacttgatctaaatttacaaatgtacaatgtctttacgcgctaaaaataacaattgtggacaaaaaaaacttagcagacaaaattgaccacaagtgataatatctaaatttggatttgttcaacgacacaacacgtaacgcgtcttcccgtatcttgcgtatgactccttgagagcctctctttaattgtcctataaatataagtctctcttgcaagacttttgaaaccacaacaaacacaaaaatcaaaaggggtcatttactatcttttaagagacgacatatatagttctcgaccaagaaaagaaaagggggtgacctgagttcttcaacacataacata

SEQ ID NO: 609 - DNA, 3000 bp, Arabidopsis thaliana
gaccattatgaattttgtaatattgtataaacaaagatagcttcagcattgatatttattcataaaaatgtattcttaatcaaacgtaaataactttgctaagaaaaacgtaaatagaataataatgatgtgtcatcacagctccttttataagttgtcacaagcaataactcaatattatcatatcatatattatatttttgaagatgaagatgaagagatttacttcaaattataatttaaggtagaactagaaactaaaatattatcattttaaaaaataattgttgatatgtgactttaatcaataactaggagcgaatcctcactatatttgttgacatatagtgttatcctgtatattttatgattttttataattgaaaaaggagaatatgtaatatttcttttgtttctttttaattaattttttagaaaaaatacaaagattaaaaaatatattaaaactgattataaatatattagtttttatgatttatattttttaataattctaaaccaataatacttaattatttgtcttgaagtttaaaattcatcaataataactaattaataatatatataaaacttaaataatcaacatttttaaaacatttttttcctaaaaaaaaagtaataaaaaaaaaagagtatagtggaaaataaaatgtcaaagttgaaaatttgaattagttaatatttatataactttttaccgttttaattttggatggaaatatggttctcagcttctaataattaattcgaagagagcacaaagcccatcctatggcacacgttccaatgtccaagtttcatagaatatccaaatatattatctgtttaaatattttaataccatcatcttctatcggaatctcaaacaacaagttcgaaaataaattatctgtttaaggtgacgtcattcccgccacgttcttgtagcttcctgatttcatccacgagctaagcaagtagcatcctcttttgtccgttttctcgtgacaactttactacctatacatatacatatacaatcaccgtattaatatgctttgaatcgtctaatcacacattatttgcagtaatatattggtataaacatcatttcttgtttgagcctaggtttgtggtttataatgtttcatatatggatcggattgcaattttagtttaattttctatttgtgttcaggtttgtcacacagattagtttaaaactaaattaggtgaacatatataccatcgtattatgaaccatctgttttaggttccaacttccaacagcaatatcgttctctttttgcatgtggacgtacgtagacaacatgacgtttgtgaatcacgtaaatttgtgtatgttttgtgtgtgtctatttgtttcttacaacggtaatagtagatagtttaaaaagataatttatacgttatgtgagaaattttttaatatatgatcatgtaattattttatttgtttttttcataattccttttcttttaattattttatttgtatttaattgattgatatactacaaaaaattcacactcaaaagaaaacattcaatttattaatatttaaatagactactagcatactagtagcagcacactgatttgggaaaaaaataaacattgttttggattatggacctataaaaactatttttaattgtattttattataaatgatgattttatgattctacaaaaactattcaataacaaacaattctacatacaccatacatgtttatgcttaatggttctattaattatgatggaaaactttaattatgatatacaaaacatgatgaaaagttataaagcatgcaccttgctgacaatctctaataaatttgtttacactaatcaaaaataattcccattgtgtgggaatcaaattccatccatagatgtaaagttttcgtaaaccaaaaaaaaaaacgcttccgagaaaaacaacaacaaaatgtttaggctcaaaagaaaacaagatcaaataaaagaagaaggaaaccgacagcaacaaaatggaaagataggattgccaagtcgtatccaatctcaatctgcgactcaattcaaagcaagatagggtttatctatattcctcgggaaacaaactgtttattttaaaatttattcagtgttcaaatacgattttaaaactttacccacattaatatataatcaccaaataaaatacatagttgacagaaaaaatgacgatacgtaaaattttaaatacatttccttgtaaaagttatttcactttgaagttgctgataaattgtgtatgaatgattgaatatgtatgataagttaaatgtatagcaattgtttcaagtaaaatgtataatgctcttactcttaagtataatgtccatcaatagttgcagattatgtcacaattgatctacattttgaggctttagtgttcaaacgtttgagattggtaggatgatacataaaaaattggtgttctttcttaattgcaccagcttcctttctattagagcgaggctacctagcctatattatacacccattggaaagaatctacgattatttcttaaacccgattcattatatggctaaaatccttgtgcaactctttaattgttcgaaccattctatatacatcacattttttcttaatgacatcaaatgaacgagacaatgaagatgtcaaatggtaattcgtttctgccataatgccctcatacgtgtcacaatcatttaccttccgaaaaaaatataattttagtccaacttggaaaaaagatatatacatcagcacaagtagtttctttttgatcagaaataaattttaaaatattttaatctaatacttcataagaaagcaatatttgccaatgcagaaattagtatataaggagatgatagggaagaagagcaaatatgcttgaagcttctctaatttcatagctcctaacaaagcaatatcatttccaatttataaaagttaaagcc

SEQ ID NO: 610 - DNA, 3000 bp, Arabidopsis thaliana
tctctttcttattttcctgagtaaacggaggttatcagcttcgatttgtttgacgagcttttcaatcaacaaccgtctctcagcatcctcaagtttagtaacatcaataatatctgacgagtcatctcctgtgtgtaacaaagcagtagtaacccttttaaaagttggtaatctctcaactgttgcccactgcgaccgaagcttctcctcatcatcaacaccatttccacaagcaaactcaacttggaaggactttgccttgtcaacatcttcacctgtttgagccattgtcaggtaaaagcagccaaagaaactaataacaacaaggagaagcaagcaaaactccacatgaatgaagaagctaatgaagtcagagttttatatatataacttgaacaaaacttacgcatacactaatatcacgcgagctccacgtgatcataaccatagaatccggtcttgtacagagagaaaaactgaacaaaagaacgaataaactagtgaaaaatcaggtaagcgttgaaaaaactggtgattcattaaagtaagtaaataaaatcaacgaagagatcttttagacaatagtcaactcactaaacaatgtcagaactgatttcacaatgtgcgaacggattcatactgacacacaacttattggctttctgtgaggcattccatcgaacactttatgtgcgttttatctgtttcggtagacgaatttgttcctgagatttgtgaatctgatcgaatcgaagctgcagtgaggtagacgaatgaataaacaatgcatgggtgagaaatcacatggataatttcttcaagatcacgtactctggaagatgagatatcacaaaatacttgatgcatgtcagagattaatgagattagcttgcattacaatttacagaggaagaatcatatgcaatcgaatcgttggcgcgcgtttacagtgttattcgctgacgccgacactgtgagaattgatgacgcgacaacagtttcaaaatagtttttggcttttataatattataaacagtccaatcagatgagtttaatcgtatttttttctatcacaagtgtgttttattaatattatagagccaaaattaacaggccaataattcacaaaaactgaaataaacaagcccaaaaaaaaaaaaaaattcccaaaagctcaaatgaataaaccctaaactgaaggaagagaacaagtgattgttgtgcgccgcatagaaaacacgtgtcagtggaaaacattttgaaggacacgtaggaactggaagagaagggagtcgccgtcagaagcttcaattccggctgaaacaccggaaaacttgttcaactggcatagctcactcgtcgcccaaaggattaatggcgaaatttcagttgtaccttggatgagaatttgactccacgaagtgctattcttcttcttcttctttttctttttcttcctcttcttcttcaatcaacatctttttaacttgggttcatcaatctttaaactacaggcagaagataaaaaaaacaaaacaaatctaaatccggtcaagaaaccggagagaaagccggccaaagacgccggagaaaagcccggcgaaacaaaaaagaggatatcttgctctcgggagataagccagccaccaccgctgaaagtagccggtcgatgccggaagctgagccaaccaacgcttctaaggaagccagcgatgccagagtagaagccgaccaaacactgctgataaagccagtcattgccggccagaaaagctgaaactggtttgctctctctgaaagatgaggagagagaagagagagaaaacatgtagatcaacaaatctatgtcgagtttaatcgtattttaatgttaaaaaaaacgtattgtgtgatgttatttacaattccccggtaagttttatatatatatatataattactcaaattaacttgaagtataagtcaactattctgaaaaattcagatttaacacaaaccgaattattatccagattttgatttatctttaactcgtggaaattttaaaacagattatttggcacgaaatattgaaccaaacacatattattatatttgcaaacaatatttctcaacattggcttatttgagtcaatctaataaaattgtcgacaaaaaaaacacaccctcacgaacctaatccaacggaagcccattcaatttcaaagataacaaggaggtaaagttcactattttttctgaaagtcactctacctacatcttttttctttctttgtaatttgtttgacacattatcaataagatcactctttcactttgttgttttctcttgattcccttttgttcagtcttcatttagctcaacttagtaacttacagattttggactccagtttattttcacgatttataaaatccatcacaccaaatttttgacatccacataatccacctactataatattcaagttgtaagacatcaacactaaggtaaattttgacattgagcttacttattaaggtaacaagatttgaatggtgaatacagacatgaacaaatatcatttgcatttactccacgtgcttaaaaacaacacatggagaaacaaaaagaaggccggcgagtggcgacaacacaatcagtgtcggaaatcaaaatcggtgaacctcaattatagaaaaaggtatcattccaaagaatctcaggaaatgacgaaagaggacaaggaagacgccaaaaacagagggcaataaagtcattatacaatcctcaaatggaccgctgaaaacagagcaccagtcgttttagatcagtacacaaaaatcacaaccactcgcataatatcatctacttctatataaagagctcgtgagctttctttaagagagacatgtgagcttcatctactactcatattgcttatattttcctacaacactctctcaacaaaaaaacaaaaaaaaaagacgttctttctttgtttgtatttagaagaaaa

SEQ ID NO: 611 - DNA, 3000 bp, Arabidopsis thaliana
aattaaaaaacgaaaaatacaaatcgtggttcatgcaagtgatctataaccacggtttgtcacgtaagtgatctataatatctatgaacctaaatctaacaatctaaatctaaaataaaattacaaagtatattactagctgattatattcatatttttgacaatacggacacgataaccttccatgcgttgtccatccagataacataccatatgcaggaaagccgctgatggtccacataagtgccgcacgcatgacaaaattctgttgggatgaaacatcaaacgcttcaacaccatgctcccataacatttgtaactcgtatataagtggttgtagaaacacgtcgagtgatcttcttggatgatgtgggccaggaacgaggatggtcaaaaatagaaactctcgtttcatgcataatgatggcgacaagttgcaaggtgtcacgataacaggccacaatgagtactgcctctcatgctttccaaagggattgaatccatctgtacataatccaagatatacgttcctttgtttggaagcaaagctaggatgcactgtttgaaaatgtttccaggcttctgcatcagaaggatgcgtaatttttccttctgttgtgtgctctgcatgccatctcattggcccggctgtgcgcttagattgatataacctcttcaacctctctgataatggtaaataccacatccgtttgtatggaattgggactcgtccacttgtttcccgataccgaggtttgcgacaaaacttacatgtcaaacgatctgaatcttctctccagaacaacatacaattgtcaatgcacacatctatcacctgatacggtaaaccaagaccagctaccaatttctgcacctcgtagtatgttcccggtgcaagattatcttcgggtgataaatctttcacaaaatcagtaatcgcatccacacaatcctcggacaaattataatccgttttgatacccatcaacttagttgcagcagataaaggcgaatgaccctttttacatcctttatataagggatattttgctgcatctaacatatcaaaaaacttccgtgcttctaaattaggttcctctactctatcactatccccatcaaacgagtgtacattttcacgaaaagcatcatttaccatctgaacggtacctacatttgcatctacttccggatttggttccactaacctatcaacaggataatattcgctacaactaccataattcaccattgactcattctctccatgcatgaaccaaactttgtaccccgacataaacccttccccatataagtgcatccaaacttgagatacatgaagaactccaaaattccgacatgtacaacacattttttttgattcgatggttaccggttgatttgtcgcgaatgccatgaattgtttaagaccttctgcatattccggcattagtaactccgttagcggatcacgcatgggctggtccatccatgatcgaaaataattaaacggatttgaagaagccatttctctctggttatattttgttgctgcttggacgattttgtgaatgatggtagaaaaatataaagatgagaattatcaatgttttcgacgggttttcgacggacgtccgacgggttttggcgacgaatttccgacggaaattttgaatatttattttttaaaataaaaaaatgcacggctatgtgaccgtgcggcgaattgaccgagtagctacttgaccgagtgtatttcgttggaattccgtcggaaaagtgcagaatattctgatgaatattctagggatcaaaacggatatattttggtcggaaatccgtcgaaacatttggtcggatttaatttggtcggatttaatttggtcggagtttcgttggaaatgactgatgaattgtcgatcatttagaattcgtcagaaaagttcgacgacattttgacggaaaacatgtcgtcagaaaaccgtcggaataccattacgaaaccgtcgaaaattttcgaccgtttatttatcgtcgaaaagtctgtcgaaaagggttttgttctcttgtagtgtaccacaacttggtttgcaacactatatatactttttgatatataaaaattctattaaactacttaaatatttcgtcatgaggttatatgcattagaaaaaaatatataacaatattgttggaagactggacaattatcgttgaaactatagctatcaccaagatacaactttttgtggaaaatcttggtggcaattagaaactgttcccaatctcgggcatgaaaatcgttattcaaatatttgtcaacaactagtgaatagtgatacagctatatatgtttgctaatttattgaattatttaatgttacgactttacgtaacaattatttaacgtctattcttgtgtacctcacatttcttatcgtcatgtctcatctcttatattattcacagtacacccatctcttctcgctcactgtggaacctgttgtcaattactcgttttgcattttattggttttcccaattactctatcaattatttatcaaaaaaaaaaaaatgaaacatttactctatatattatttccgcaaacacaaattatactcacatcaacatattcaatacatttttctagtaatgtagaacaactttacagtattctccaaaacgaaactctaattcaaaatttacaagcagataagccaaagataatagaacaacaaaacgccaaattctagttaagcacacaatctcaacgtgcactaaaaacgagtggtgtaagtgaaaaatatcgtcgattataaacattatgggaccagtagcatttgttgcaccaatcgaaaacagacaagcacacatatctcctcatttctcatctggcttcttaatcatttctcataaccccacctcattataaataccaccctttgcgtcacacatataaacatcacaaactaaacaataaaccataccataaaaaac

SEQ ID NO: 612 - DNA, 3000 bp, Arabidopsis thaliana
ttgtctttggtagcaaatcccagtcacttggaagcagtagatcctgttgtgataggtaaaaccagagcgaaacaatattacacgaaagacgagaacagaacaaagaacatgggtattttgatccatggggatggtagctttgccggacaaggagtggtgtatgaaactctccatcttagtgcacttcctaactactgtaccggtggaacagtgcacattgtggtgaataatcaagtggctttcacaaccgatcccagggaaggaaggtcttcacagtattgcactgatgttgcaaaggctttgagcgccccaattttccatgtcaatgcagatgacattgaagcagtagtgcatgcttgtgagcttgctgctgagtggcgccagacgttccattctgatgttgttgttgatttagtatgctaccgtcgctttgggcataacgagatagacgaaccgtcattcacacaaccaaaaatgtacaaggtctggctattatatcatccatctctgtgaaataatctaataaccaattcaagtttccatttcatacttttcttgtactttttttttgtttaaaaacggatgttacttgttggtgataggtgatacgcagtcatccctcgtcacttcaaatctaccaggagaagctcttgcaatctggacaggtaacccaagaagatattgataagattcaaaagaaagtaagctctatcctcaatgaagaatatgaggcaagtaaagattatattccacaaaaacgtgactggctggcaagtcactggactggattcaagtctccggagcagatttctaggattcgaaacaccgggtaaaaaacatttttatttcatttagtttgtcaatgccttttggccttttttcttttctttttcaatgtaacattttgctggaaaactattcccttgttcttttgcagagtgaagccagagattttgaagaatgtgggaaaggcaatctcaaccttccctgagaactttaagccacacagaggagttaaaagagtttatgaacaacgtgctcaaatgattgaatcgggagaaggcattgactggggacttggagaagcacttgcttttgctacactggttgtggaagggaaccatgttcggctaagtggtcaagatgttgaaagaggaactttcagtcatagacactcagtgcttcatgatcaagaaaccggggaggaatattgtcccctcgatcacctaatcaaaaaccaagaccctgaaatgttcactgtcagcaacaggtatgcatttttttttaatctctagagatgataaccactcttcaattgtttttacatgatctttacgttgtttgtgtatgcagctccctttcagaatttggtgttctcggtttcgaactgggttattcgatggaaaatcccaattctctggtgatatgggaagctcagtttggagactttgctaatggcgcacaagttatgtttgatcagttcataagcagtggggaagccaaatggctccgtcaaactggtctagtagttttacttcctcatggatatgatggtcagggtcctgaacattccagtggaagattggaacgtttccttcaggtatattatatgaccgatacttaccgttaagattctctccactttttgtatttgtttccctctcatttgaaaattttaactgcagatgagtgatgacaatccttacgttatccctgagatggacccaactcttcgaaagcagattcaagaatgtaattggcaagttgttaatgttactacacctgccaactatttccatgttctgcgtcggcaggtaaaatatctatttatcccaagttcgtaaaatgttgttacttaattttcgtattcttcacactcacatgcttgatatcatccatttgcagatacacagggactttcgcaagcctcttatagtgatggcccccaaaaacttgcttcgtcacaaacagtgtgtatctaatctctcggaattcgatgatgttaaaggacatcctggatttgacaagcaaggaactcgatttaaacggttgatcaaagatcaaagtggccactctgatcttgaagaaggtatcagacgtctagtcctctgctctgggaaggtataaaaaaaaagatccactttttccgtcattaactaacaaagttcccacattctgaaatttaatactttaaatgtcaatgaatcaggtctactatgagcttgacgaagagcgaaagaagtctgaaacaaaggatgtagccatttgcagagtagagcagctttgcccatttccatatgatctcatccaaagagaactaaagcgatatccaagtaggcgtcgaaaactcaagtttgtgttcaatagttttggttgattatggaattctttgaaacttttgttcttgtgtttaacagatgcagagatcgtgtggtgtcaagaagagccgatgaacatgggaggataccaatacatagccctaaggctttgcaccgcgatgaaagcactgcaaagaggaaacttcaacgacatcaaatacgttggtcgtcttccctcagctgctacagccacaggattttaccagcttcatgttaaggagcagactgatcttgtgaagaaagctcttcaacctgaccccatcacccccgtcatcccttaaaaaaacacagcttgagaggcttgagcctgtataaaaaagacacaacacaaaaataaaagattcatgagagaatctttggttaccaaagagtgtcactggaaaataaacagatgtttgctagacttacaaatttaagtttattcgatttgtttggtttgttataggatttaatcgagataaaaggaaaaaagatttaaaccgtttggtttagtatgataattcattaatttggttcaactttggattgattttggttcggtttggttttatcagtgactgtatcagcttgaggcagttgcaatcttgtaactggagagaaaaagctatcaaagttaaaagtt

SEQ ID NO: 613 - DNA, 3000 bp, Arabidopsis thaliana
aagagtgaggatagtgttgagtttagttacctgtacagtatttgatccaaggagaatgaattcagcggcatcatagccagtttcaactcctccaatacccgaaagcgagcgatcctcactaaactcagatttcatcattttggcaatgttcataacttttgccagtgcaattgggcgaacggccttataagagtatccccctggagtggagtaactgcaaaacactatcaacgttagctattcttgtaatgccattacaagatttgccaaaacgtttgacattataaaagtgctatctagctaacccttcaacgcatggctcaggacgcaacgtcttcatatcaattcccattacactcatgattgtattgatcgctgcaattccttcacatccggattttagtgacaccctagcaggctattcaaaagaaaaagcaaaacggacatggtcaaagcagagcaaaacagagtaacaataactcagctttaagtagggagcttttcaataaacttgcatcaaagtttttttttcattttctacaaggataggctttatacaaaatggttgaaaaaccaggaagcaaaaaggctgagagaattagatgtcacacctcagttatgtcagtaatattaggagtcatcttagcccatacaggaactgtagctttagcattaatccatccgcaaacctcgtcgagaagcgcacaatcttgtccaacagcggcacccattctgcgctctggcataccatgaggacacgagaagttgatttctaaagcatcctacacaacaatcatccagaactgtctcttcaacaatgtatactaatatcagacaaagtgaaagagaatctaaccacaaggaagaataagaatctgtgttttagggaaaactcacaacaccagtttgctcaacacggtcgataagctcttcccaagcagttttgttatattcctccatgactgaagcaatcagaatccgatcaggatactcttttttcaaccgctcaaactctttgagcatggtttcaagaggtctgtcactgatgagttctatgttctgccacccaattacatctgttttggctgagccattggatccggttcgtagccgagcatatctaggtgtcacgttgataactttggatgcatctaaagatacctaaatcatccaatcacagattcagacgaaactcaatatcatcatcatcatacacaaacacaaccaaatcctatgttccaacatagtcaacgcaaaacagactcaatcatcatctactctaaaattgaaaaagtcaaatctcaagagcttacggttttggcgatgacggccccccaaccttcatcaaaggctctcttcatgacggtgtagttggtacccggtggacccgacccgatcacgaaaggattgggcattttcaggccatttacagtgacactgagatcaggctccgattcggcggcggaagagatcttaagtccaactctagtcggcggtagaaaactccggcgagaggatggatcgaagtcagctgataaggtggttttagaggagagtccagagaagcgattcaaggcgaaactcatggaagccataattagagagatcaatctggaaaattggcagaagtgatcaaatcttgagacgtgaaactcaagaattatgagagagagaagacgacacgcaacaaagtgtgacgatttcgaaatatgtgagagttggtgatcaaatcgaagaacaaaggaaagaacttaagaagatagagatgtaagagaagagtgtgttgtaataattggtcggttcttcaacttcatgccacgtgaaaataattgacgtttttagttaaagttcataattagttaataatacattaatcacccaaataataatagacccatcttccctaatccataatatttaaaaatatattagtttagttttaatcaatgtatttaacagttattttcttctctatcttatctccttgagttatttttaatttttttttgtccaacggagtggatataacttaagattctctgtctctatcaactaatgcttgatttaccaacaaatttcggaaaatggatagttttagaattactcaatttatatgtcgactacgtggaaattgcgaacacgtaacgtaacggatccaccgtgaggttaaggttgttttctagtgtatacgattcttgagcccaagtggggtaaagagcccatgcgtcacaaaacaaacaaaacgtttcataaataatacgtgtaagtgggaatggacacaacatcagttggtggctctcaacgtttctcttccttcgttagtttgactctactttttctcgttagtttgcgtaaagtaggcttctaagattagttaaaaaaagttaaaaagttaaaaagttaaaaacctagagaccattctagattggtaaataactaaatatgatgtaaagttttagaccaaaatggcaaaatactatatacctaatcatccagtaatttctaaaaagtttttgattgaataagaaaacagaagagaaaagtatttggtttagactttagagttttaaggactgcaaggattttactatcgaactttctagttcaggtaattagatagtgatattattgtgttcgatatttcaatgacgctacaaaaagaataattcgtctttttttttttaaaatatcgttattgtacaaactacaaacgaaacgaagaacacacaacataaacacggcctcaaataatttccatggtctcaaaatatttaaacgaaaaatataattttctgagtcctttcatttattattataaataatcaaatccgactctcattatttctcaggaaaactaaaccaaagtctgtttaccagtaatatcaatcgatcgccattctcgacatttctctctctcaagctagtctaaagtttcttcttatctccttcctccgaccaaaacttcgacttctctcttattttcaccctcagagagtaacc

SEQ ID NO: 614 - DNA, 3000 bp, Arabidopsis thaliana
ttgacatctcacgagaaagacaagtaaaagaaaaattattgttctcctttcgttttctgttttcaaccattcaagtgagagagagaactgacatagaaaagggcaaaacggtcaattaacaacgttgggcgaaaaaaagtataagatcaaagaaaaaaatccgacctgccggaatcgaaccagcgacctaaagattatctgcaaacattacagtcttccgctctaccaactgagctaaggtcggttgttaattgcaattaaaaattaattatatttaaattataaactcctagttttgtggcaaatctgacgcgtatcatgactacaaccattcacttaccaattacaattgattttgtaaacctttgactaaaactatggcactaaacgaagacgacacaatctattccaacgtttacaaacattcaacaaccctcagaagttgatctcacgtctctctgcgaagaattttccggttactgcctcttcggaaaggaccaggctaagccaaactccagtatcagctgcatcttcaggtggcatatttccggcgtagccagtcatcgcagtcttcacccaaccagggcaaaagctgttaacataaatcttctcttcctctcctcgtctctcaagttcttttgccattagtctcgtgtaagcattgactgcaagcttagacatggagtagtcagtgaatgtctgaggccacccgcctgattcccaagttccgtcttttacttggttgatgaatttagagacagttctgtctataagttcctcggtcagcaaatctggactgcttagctgatctctcaactctacatttgccagtctctgcaattcatgaatttcaacgagattttcttttttcaaaaaaaatcaaagatatgagtgaaagagtttcttacattacgtcttccatttactctacctagccgagaactaacattgactacacgagcgccatgaggagatggtctcatcaagggtatcatagcttttgtcatgtttttggttccttggtagttagtagatataactgtttcagcaaattcaaccgtattatctgagccgagattgtagttaacacctgcattattcacctgaaaaacatagcaacacaaatgcatgtaattcaaatctaagaaaacattagaactatcctccaagattacgaatcgataaggatcttacgagaatatctaaacctccaaatgtttgcttaagccagcaaccaaactctctaatcgacgaagagtctgtgacatcaagttgatgaaaataaaccttgagaccttcttcttggtgcctcaaagatttaactgcttcaagaccagcattcacgtttctagctgtaagaacaaccgtcaatccgtgaaccgcaagctgtcttgcaatctcgaatccaatcccgcggtttgaaccagtcactactgctacattttcacaagaccaccacctaaaaaatcatttgacgcctaatgacaagtcaaattcaaaaagagggcttgagagacacatacttcatcattttcaatttctctaaattcttttggtttagtgaaacacaaatctgtaagtaccaacaacaataccaattcagtctccaactcccaaatagagaaaaatagaaactcatcaaacactgtaagcgacactaagaaatggatttaagcaagtgaaattagagattaacacatcgaatgctgtgaaattgagaatctcgcagagtaaatgatgatagatcttaggatacaaagaagccgaaacaattggacaaattaggtctcttcatacctatggtggtcagagtaaggaatagttcgaaggagagagatctcctgcattcttttctcccttctctctcgagctttctccttgttcgtcatcgtcttcttcgctcgcgtcgcgtgtttgggtgtaccgtttatcttactcctgaatcaaattcgttgtacattagccatcagctctaaggaattaataaatgagaccttcaactttaataaaaaccacataatggcccaaaccttatactcttaactattcaatccaccagacaccagtaacgcttggcagtcaaatctttattgagtgggttcatactctaaaccgtttactgaaatttaattcaactaaacaaaccaatgatttttcatacaccattaattacaaaaactacaagatgaaaaacttttcacgatatttgttcgaaaatctaaaccaatgattttttccctcaatcttcgtttatagtttaatttatggtcgtctatctacttttgtttgttttatttgtcgtcggttgtctaatatccatccattctcacataaatgtttagtggtactatgataacctaacatgattgtgtgagataaaatagaagaggacaatactagcgggtttgtgacgagagcggtgacgtcactggtttacacgtgtcacgtactaacgattctcgcgtccatacgtctctgcgttcatgggctattgataagtattaaatagacaactcccgaatttgttttgttactcatcacaatagcgggaaactcatccggcttctggaaatttccgtttatccgattcgttctcacgtaaatcactctctctctctcgctctctcgctctctctgtatcgtctctgtttgatttcgcaattgaattctgggtttaggaatctcttattgtatttaatttgacaatcaaattttgggttttttaaataccaaactagaaagtgagattacgaaagattgttccatagtggatacgttcgtctttcaaaaggtaagtcaaactttttttttttgggcaaaggaattttgaataagcagcacaagtactaaaatcttctgattaaaattaggtttcaagtggttatcctctattgttcatagtttgagctaggtttagagtttgtgatatcttatccatgtttatgaatttgattagctgaatcaatctctttccttttatatatgatcatgaaacaggag

SEQ ID NO: 615 - DNA, 3000 bp, Arabidopsis thaliana
attcagtgaaccaggttggttcatgatcccttccaaagcggactcacaccttagactcggagctcacacgccaaatcgctcggctaggttttgatagccaactccggccaaaaaaccaatcgcgagaatgtggtttttgattgacccaactcacattttgacctagcacgaaaaccaaacaccaacatgaaataagataaactattcaaaatatctagttttatataaaaatcttaatttaatgtcacgagaagcatgttcgcactactaaagttaattagcacagtttcgaacatttatatatgtatattctgcagaacaccgacgactccaataatggtcacgactcacgacccatgtggagtaatagttttccttcttttttaacatttataaattttaatatttattttcgaaaggctaacaaacgcatgcgtacctttacatgaaacaaaaagaaattgtagaataatattgtttgaacatttctagatattcatgtgcatattgttcaaaacttgtgtatgattgtatcattgattgttacataagtatttgttaaacaaataaaaactatacaacgtggctacgtatcaatctatgcttagcaaagtcaaccatgtaaattttgtaagtattaccttactctaagaaaataaaaccctaaacgaacagataggcttgcacctgtataatatattagacattacaagtctctacaatgttggtttatcattaacaaggactaaacaatatactataatcatacaataaattaagagtcgtaaattaatggtaaactcaactaatgcatgaatagttgtaaaagtatatatatttggacacgttactcaacttgcatcgcggatctgtattccttcccaaccactacgtacacgcatttcccacgagtttgacgatctttctcgtttaatctaatcatatctacttttataggctccatagcccacatttcatatcttatagtacgttccaacttctaaccaataaactcaaaactagttgagttttttaattagtgaaatatatcttgaattttatatatctaatcttgcaccaataaagtttctgtcaattatgtaaaagaaagactcgttgtatcagtatgggacgactttttcttctgaattgtgtcgatcgagtccatattataatactttgtcacgtactttgtttactgattaatttaatataattgtgtcgcattatccaagtctaattaaacattaatgtgtatattatacaccaagttacaattacagatctatctcttagtcgttttattatgtatagcctacaatgaaacatgacatcaacgtataggtgaagctgaagcctatacataaaagtaaggttttggagtttgtttcatgttttaaggttttagatattttgtgatcgatttgcatgtatagggttccaaatatctgagctttggcttggtctactttgagaaagcagctgtagagatcaactttagccgtttaggtgataaaatcacattagaactctataggtcgcgtagcagcgtataagagccctggatactgaaatacaagaatctctccacgcgtagaaaaacgaaccaaccatgataaaacacgtgtcatatcgaataggtacagacaacgtgcacttgccaaccttctttccttgtagtttccttcttctttgcttctttttttcgttaaatattgatattgttcaaaaaacgcataacaacaaaaacgtggtcgacggaacatgtgggtggtggagttgtcttctttaggggaccactcactaacgccgtttactttcccgcttggacgataacacccttgatatatggattagtctctcttttgcttttggatatcttaatatattttaatatgtccatttttatattgacgaccatttaattaggtctcagtttgtattattgatttttaggtgccaagcattactttcgttacgtgtaatcttttgattattcaatcaaattatcatatggttcatggcattttatcaattgtgacggtcgacatgtgggttgactttgatgtatgacttttagcttgtgcctcatttttattccaactcgacaactagcagactttatattttaatttatttctttctagatattagacaattcttagcttgtctctctgcatgaatcacgcgttaatatacttataatagtaagttttaaaatgtttcgagtataatatcatattagatttcaattataattgtaagattatttagtctcaatgaagagcatttaaaaatgtgaaagagtttaggctttgactgttgactggttctaacgcgttttgcttcttatttatacaaaaagattttattttattttaattagaaatattaagtactttttagacgtgtttaggttgattaatttcttgttaacatatccgataaaaaaaaacagcaccaaaatcacgacgagaattatgcctacgttacgttgataataaagattagagataaaatgtaacctctcttctctttacatcattacatgcatcttgtgttttatttgactttattcttaccaacaaacaaccaatggataaattaggctcgtgaaggagggcaaactcgtaatttcaaagaaacggaaagcgtcagaacgtggagaacagtgaaccgagacacattcccgatttttctaaagaaacaaaataaaacacgtgttttttataccataagtaaagtagtagtatttattaaactattaatatatagctttgttatattggaggtaggaagaagaactctgcaaccaaaccaaccaaccccaaagccaaacaaagttttatagagaccttccatttctccctctcgtgacaaacgcaatttgcagagaagcaacagcaacaacaagaagaagaagaaaaagatttgagattactttgtatcgatttagctattcgagaaactcttgccgtttgaaagttttaattgttaaag

SEQ ID NO: 616 - DNA, 3000 bp, Arabidopsis thaliana
taagttccaatttttttttttttattttgttacaatacaattgtggtctatattaaaaactctttaaaacataatccataaaaattcgaggcgtatgcgttcactatctataatgtcatgttcaactatgacgcattggctctatatatatattatgtatgtattacatatattatcaatgtttggtatgagtcgggaaaaaataaaggtccgatccactatactaatctttgtgcttctttcgtatcgacgccatcatttcatcggactccattttaatctagttcatgctataataaacaaataataaacacacgtggatcaatttcatgcgagaaagaaaaagtcgtttagacatacacatcacttcttatcatttacccaaaatgctaagaaatataaattccattttcgaccattttaaaacctatttctccacgtaaacaaaaaaactacgcaaaaaatcgaaaaagtagttttttctctctctctttttcacactcattatatctataacccacatattctaacaaatactagtagcatttacgaatcaagattctccaacataaaatgtatttctcacttacttctccattatcgttttatgtacccttttttttacgtaccaatcaaaatcgcatctttcttttcaaatataattatgtatatatacgcatgtgcagctgctgcgtgtctatgcatacttgagtctaaataactatccctgactatgatatgtcgttggttacgaatgtgatctttagttaaaataacaagaataatatcacacagacaaaaacaaataagtgcatattatttcaacaagattggagtgggtgggcctaaaggcttaaaaaaatagagcacatgcacagaggaccattgattccccagagacaatcagacatctgagaccctaatcgcatcaagccgcgtgcccttcttccattaactaattttgtgtgtttgttttggcttaaacctgagaattacattgattactttatttgtttcattttctccatgaaggagataaaaagagtaaaaattagagattgatgaaaactgaaaaagaaactgaagtcggtaagataggtgttggaacttggaataatggcttggctttgaacaaaacgcatgcaccattcattgccttcaagttttttgcaattagctttgtttttgtttttgtttttgtttttgggagaggttctaatgaccaagaatcaagagcgttgtctaaaatctaaaccatatgatacggtttttaatattctcatgcattaaaatgtactatttctatatatgatcttatatacccaacatcttggaattaatagtttgattcgttatcatttgaagaagctctcaacagcttcaaaaagcgaaatgtagcatcatgaagcggtatccaatttcaagaagctaccagtagcttgtggaagttttcaagaagttttccggaagatccaacgattgtggaagcccctcatagtttttggaagttttcaatgatattagcagcgttgagcgtggcatggctagacaatgtaagagatttgatttgcaacacatttgatgtatttttttacttttgagttacaattgtaatgtattattgattttgcccagttatgatttataaaccctacaatttagtatcaaagtttttatttaaaattctgaatctgacattaatgatatctggctcatttacagagccaatgagatggatgatgttcgaaactggattggccattatttatcttttttttatctggagaatctcgaggttggcacaaacattatcatattagcctttagaaattggattggctaatcacacatttatatatattcttaccaaaataaatcacctctcccgtaattgaaaaatatctaaatactgtaagtctgaaaaaattcacaagggttcgaagaaagaaggaaatatctaagcatcattaataaactatctgtaacctgagggaaaatcatttcatgttgaaatatgtggatttggaagttttataatctatctgaatttgtgaaatttgataacaagtaagatttgtttcttaacacaaatctaaaatttgttttctaattaggtttgagagagagagagaaagaaacgctttgtatgatacacatctaggctatgaatgaaggcagcggacaaagcggtctaatttgtctgcggtttagtccatctcatttttggggtggacaataaaccgctgcggaccaagtttatttgtatgtaaaaacggtccgcagatggtccgcaacgattttcttctatttttttaagtccagaccactgcggactataattgatgaatgataaataaaaaacggtctgatccgttgacggttttgtccgccccaaccgccataaccattcaaacccctaattatttcatcagataacattatacactaataatcattgcactcaaatatgtcacacaatcatataataaaataataacaatgattaaaatgaaaaaattgttgtggcgccgcataaaatagaaatcgtgagagacgacgtcatctaaaaattgccttgctgtccacttttcactttgtcctctcttctcatctccgttcacttccacggcgtttcctcagccgccgattttatttatttcccaaaatacccatcacctatagcgccacaatcctctacatcacaccctaatctcattaccatacaccacccaacgaacacgcgccacttcatttgttagtatctaaaataccaaacctacccttagttccacacgtggcgtttcctggtttgataacagagcctgagtctctggtgtcgctggtgtttataaaccccttcatatcttccttggtgatctccacctttccctcacctgatatttattttcttaccttaaatacgacggtgcttcactgagtccgactcagttaactcgttcctctctctgtgtgtggttttggtagacgacgacgacgata

SEQ ID NO: 617 - DNA, 3000 bp, Arabidopsis thaliana
tattcgattatatgtgctcttacaaaatgaaatatatatgatttggacatgcagtactcggtttcggatccaaatattgtgcatgtatcgacgtcgacgttgcttgagacacaaggagcagtgacattgaaggagatttcaagttacacttatgaggtgattaagaatattggagttggtgtgattgacatcgttgatccaccaagattagggtttcaattgacccttggcctaaaccttgataatataccacgtggcaaaggtaagcttcaatattgaaatgtactttttcccgctacttagttattataagtttttttcatatttactcattcaaatgcagaagcgattaaaatcattacaaggatttctgaactacaagcgataatattaagtagccaactaaaagagatgctgagaagtttaaattttcaagatgattcacgatcgatcaacaacatgcccatcaggattgtttatcacccaagtgaacctttctacgtctttaaacaggtttattttaccgcgttttattcgtttatctgagttacatccaactaaatataataatggatagagaccaacgtctaaaatttatcgaataactataactataagaataagtctttgaatgttttttcagccggaaaaaatcacggccgtgtttccgatgaattttaaagacaattcggatgtggtcatcgccacgtcattcttccaggtacaactaaaatgcatacaatcaatgggtgggactagagttttgcattgagacgtcactaaggtttcctttgtcaaattttatctttttatgttaaaaacaaattggacaatacatataaaaaggaactagttgaagtgggaagccaaaaggatatgggaaaagccccacaatgtagttggtcgccaattcctcctctccaacttagaggagaaccggttcaagacttgaccaccaattctggttttgtatcatttggtacgttttgtgtcattttatctgtttataaaacttaatccaacatctttaattagtattcttaaatgtcaaagttcaaacaattctcattgcagatattacttcacggcacattgaaggaaagagactggacaaaacggtttggaacttgctaaatttctacgcatgcgctaagtaccatattaaggtacattagttctagtttttcaaataaaatataatagattttgtgttcttgtaattgaaaattttcaacctcgtattgtttaaatagtgctcgagagggtacatacagagacggatgagaaaaagaatggaaactttagttaaggtatttttatcatatattacgtacacacacgaatctacaacaatagttgacatttcataaacaaaataacgtatgtttgtaaatttacattatatacgtagctgctaaataacacaagcctagaagaagaagctgctcaaaatggtatcctttttttttgttacctttaaccttacttaggtttgtatatataaaaaagttatattatcattttttcttttccattctctaatttctatatagaaaacggaagatgcaaatacgtaaaggagtttgtgaaggtaccaaaaggtaaattgatgatgaaacaaagatgcaaggagatgacaaggagagtgaagataagcaagttccggatcaaaatcaacggttgtgctcggtttcgattcaatcagcggtggatatctctccccaaattctcttcgaaaccatcagataaatcatacacaaaattggactaagtaatcacttaacttggaaagtctcaagaaagaggctcggtgttgttgttttttttctttgtcaacatgctttaaaattgaattcggggagcaatattatacgttaatgaatatcttgacaacaaaaaaaaacgttatcagataaacttatggatataatttggtaaaccaaaaataaacctaatcaaaagttggcattgaatgcagcatgttacgtaagagctttgtacaagtaccattcactctttttacttttcaatgtatacaatcatcatgtgataaaaaaaaaaatgtaaccaatcaacacactgagatacggccaaaaaatggtaatacataaatgtttgtaggttttgtaatttaaatactttagttaagttatgattttattatttttgcttatcacttatacgaaatcatcaatctattggtatctcttaatcccgctttttaatttccaccgcacacgcaaatcagcaaatggttccagccacgtgcatgtgaccacatattgtggtcacagtactcgtcctttttttttcttttgtaatcaataaatttcaatcctaaaacttcacacattgagcacgtcggcaacgttagctcctaaatcataacgagcaaaaaagttcaaattagggtatatgatcaattgatcatcactacatgtctacataattaatatgtattcaaccggtcggtttgttgatactcatagttaagtatatatgtgctaattagaattaggatgaatcagttcttgcaaacaactacggtttcatataatatgggagtgttatgtacaaaatgaaagaggatggatcattctgagatgttatgggctcccagtcaatcatgttttgctcgcatatgctatcttttgagtctcttcctaaactcatagaataagcacgttggttttttccaccgtcctcctcgtgaacaaaagtacaattacattttagcaaattgaaaataaccacgtggatggaccatattatatgtgatcatattgcttgtcgtcttcgttttcttttaaatgtttacaccactacttcctgacacgtgtccctattcacatcatccttgttatatcgttttacttataaaggatcacgaacaccaaaacatcaatgtgtacgtcttttgcataagaagaaacagagagcattatcaattattaacaattacacaagacagcgagattgtaaaagagtaagagagagaga

SEQ ID NO: 618 - DNA, 3000 bp, Arabidopsis thaliana
tatcaacgatgtgttggttatgtacacaaggtaaaatacatcgattcatattatgcataatataaaaaaaataaagaataaaactacattttggtaacttgaattcaaccatgaactgtttggattggcaaacataaactcaaataaaatatctaggtataattgtggttcatacaagaattacttcatactgttgggccaaaggacgtatccttccccgcacctccaaaccatgggcttactactgatccgacatcaaaaccgtgttagttgcaaccaacgaatgataagtcaataagattcaacttgtcaacaaatatacagcttatatgacatgtctggctccaaactgaattttagtagaaagttactaattcataaaattaatttatatacaatttttcaatttttattttataaattaaagaaaaaaacatgaaaaatacgggaggttcggcaaacacaacatttaacttgccaaacgtatcatctaactttcccaccttatacaaggaaccattttttcaataataaagtttttttttttttgtcttcgcaaataagagcacgaaatgtttgccaaacgcatatgcaacaaacccacgttacataattctgtttacagccatagagcaagctatattgttaaagacctaaaaaaaactttactataacatatagaggcttcgagatatttcgaaagactcaacttatatataaataaactcaaaaagaaaacacggaggcgagaggatcatactctcacacagaaagagtcacattattatatcctctaaaaaaccaaactaaaacgacacgtgaagtcttgatcagccgataaatagctaccgacataaggcaaaactgatcgtaccatcaaatgtaatccacgtggttttagattactcgtggcaccacactccctttagcctataaatataaaccattaagcccacatctcttctcatcatcactaaccaaaacacacttcaaaaacgattttacaagaaataaatatctgaaaaaatgtcagagaccaacaagaatgccttccaagccggtcagaccgctggcaaagctgaggtactactctttctctctttgacagaactcttaaactggaaaaaaattgttgaagctataactctttgaaaacagttgaaacttgatcattactagaaatttcagttacttgtttaatttagtttgtcgtaattatgtaattgatgatttttggttacaatggttgtcatgtaggagaagagcaatgttctgctggacaaggccaaggatgctgcagctggtgctggagctggagcacaacaggtaaacaatccatacacagacacataacatataatatgtaacgaaataaacgtctttgtaagcttacatgtacgcagatttctgatatggttatgtatatgttataggcgggaaagagtgtatcggatgcggcagcgggaggtgttaacttcgtgaaggacaagaccggcctgaacaagtagcgattcgggtcaaatttgggagttataatttcccttttctaattaactgttgggattttcaaataaacgatctttgatcaagaattgcattatatatatataaatatattgcaaaattattagacgagccaaacttatattcaaataatgttttatctattttaaaaaatattctttatgcgaaagatcaaactccccaaacgatgttaaatggatcacgatacataagtcgatccgaattgttgaagttttctaaaaatgcagtccttataattgtattaaacacactaaatcttccaaacacacagaaggaaatcactataattgttataatggatataggagaactaactaaaaaaaaaaacgcaaagaaaactttatacagtacatactcttatggtcttaccaattaccaacgatgtgttggttacacaaggtaaaatatatcgatcgtagtactggattcatattattcataatatgatgggaaaatgaagaataaaagtacattttgtaagtagaattcaaccatgaactgtttggattggcaaacattttttatttgtttttggcaaacataaactcaaataaaatatctaggtataattgtggttcatacaagaattacttcatactgttgggccaaagggtacgtatccttccccgcacctccaaaccatgggcttactactgatcggacatcaaaaccttgttagttgcaaccaacgaataataagtcaatacgattcaacttgtcaacaaatatacaacttatatgacatgtctggctccaaactggatttgagtagaaagttactaattcacaaaaactaatttatatacacattttcaatttttattttataaatcaaagaaaaaaaacatgaaaatacgggaggttcggcaaacacaacatttaacttgccaaacgtagcatctaactatcccaccttctacaaggcaccatttttttttcaataataaagttttttttctttaatttcttcgccaagaagagcacgaaatgtttgccaaacgcatatgcaacaaccccacgttacatatttctatttgtagctatagagcaagctatattgttaaaaactaaaaagaaaatctttactataacatatagatagaggattcgagatatcttgaaagactcaacttaataaataaagtcgaaaagaaaacacggaggcgagaggaccacacactcgcacagaaagagtctcatatcctctataacaaattgataaactaaactaaaacgacacgtgatgtcttgatcagccaataaaaagctaccgacataaggcaaaaatgatcgtaccattaaacgtaatccacgtggtttcagattacacgtggcaccacacaagtatctccatttggcctataaatataaacccttaagcccacatatcttctcaatccatcacaaacaaaacacacatcaaaaacgattttacaagaaaaaaatatctgaaaa

SEQ ID NO: 619 - DNA, 3000 bp, Arabidopsis thaliana
ctcaatcctgcaacacttgagactgagagtctctgtcagacccacttcgcttcttcagaacgagaatggtttcaagagtattggtatttttaatttcacatcagaagcagctgcagatggaggccaagatcaaatattgagcagggttattgaactggtgaagaaatacgacaaaaccaacacctctgaggttagggattacaaaactgctgctttttctttgtgtataaccttttattttggtgaatggttgttttgtaacacggggcttgtttacttgcaggttactgaaagggctgattttcagaaagatttgtcgttggacagcttggacaagacggagctagttatggctattgaagaagagttctcgattgagatccctgatgagaaagctgataagcttacttgttgtggtgatgttgcaacatacatactctctgaaactcctaccaaagcgtctgagtcctgagttgtatctctgcctttctgtctctcttgttttcaatgtttagttaatgcaagtttagagacatgctctgtgtcagtgtgtctttgcttcagccaatatgatcatttgggtttttgctgctaaacattttatatgatatatattctaatgtgatcacactacttttgtaccaaaaacatgggagcctttatatacatgatgcttacagttgtttgttcttacactttgggaacatgaaacacaatgtagagagactctaactcggttctgtgactggagcgccagctaagcaaacgaggaccataacaaaaaaaatgcttttcacatgaaggaacttgaagaatcagctgtttgtgttcaaatcttttggttgaaatgttgtctcaacgagcttgctatgatctcgaactgtggccctgtaacctgattttccctgaggtgtagacacggaaaccattggtagaggaaacaagtttgataggtttgtgtatattggtagaggtgttatagcatctatagggcctaggcacatatactggcttgatgaaacaagtgttttcaaggtgtggaatcgcatggagttgggagggaagatcgatttcaaactctcccaattcatcagtaacagccttaatccatttggacctccttttggatccagtgtggcacttgatggcaacggtggcacctgcgaggatcatgttagtatatattcggacggaagacaagaaacatgaagaaaaaaggtagagaaacaaatacctgggatagggatggagtgaaggtgaggacgtgaagtgtcgcagagaagagatccggtgatcacgacagaggagagtttctgttcaccgtagccagccatctccaccatttccgttctggtccataaattattcccaaatgctccggtgaacaagaagaaagagagtaacaagaagcaacggatgatgaagaagcttcccatcgttaaaaacaaagaaaagaggtttgtttgtttttctttgtattttgttaaagaaatgaaaatagcatgaatatatagagaagaagaaggaagctaaagaagaggaagagaccctttgcgtggtggcttcaggtcacacagctctgtacggcagtgtctctctttataccttgtagtagcctttttcttttcagttgtatcttttctaaatatattaaaaatcgtggctgacttgttagggtcaaatttagagctgaatcttccaaatgaaacaatgaaccgagagcgaaagagaaagagagatacggcacttggaagcaattactgagtggttcgcctactctttcactccttgtataagtattattttaataataatatttggtgcaacgtttttgtatctagtgtgacgtttctccttttctttatttaattaagccaattcagttagagtagtcatgcagtaaccaaaagattcaagcctaccctcaactatactcgcacacattcagctttgaacacaacggcttcaacatcgtgggtttggtcgtgtctacgtgctcagaatatctagttgatggtgggagtcagcagggttttgaccaaaccacagtttctcaagtcctcattacattgaaaaaagtatgggcttaaaagaagcctagatattgataataggtccatcacctttaatgggccattcagtttgattatcttaacggcccattaggattctccaggtgggacaagtattagctatgtcattaagagcttaatacagctggaagctggtgattattgttaatgttaactaatcacacgcttagaaaagcgacaatggttggacccacaggagaagatcgagaccgtcaaaagtggacaaaactgggacgctttttgtttccaaacagctgtctgatctgattggtcgatgcagttttgatggcaatgaaccccaccacagaccacaccctcatgatccaacccaattcgctcgtaacacaaaaaaaaaaagaagtgaaaaattgaccgaagggtcgttgagtggcagttaccctctgtctccctaacgcccacctatcttctccgtgttttccacgcgctatctttctctcttctgtgtgtttaccacgctcctcttatgcgcgtcggctcgtgacaaaagtgtgccgggtccactaactgtccacaacacgtggcaaagccttaaagggctgtctatctctcaaacaagatcaattccaatccgacggtcgagcacgtatccagttgtcagaatcttatcagtaaacggacggttcatataagatcacgtgtcaagtgagcagaagtcgtgcgtcctctctttatataagctccggcgactccttcaccactgtgtacaataccagccgacacttaacaattcacacctgctctttttactctttctaaaaccctaaattttctcgcttcagtcttcccactcaagtcaaccaccaattgaattcgatttcgaatcattgatggaaatgatttgaaaaaagagtaaagtttatttttttattccttgtaattttcagaa

SEQ ID NO: 620 - DNA, 3000 bp, Arabidopsis thaliana
acatgacacaagccattgcaggttttaaccactcttcgaacatagttagtaaaaacaagaaaagaaaaaacactatatttaattgaggttcaatcaagactaaaccaaatgattcacaccactcatagtctcagtgtggttgagagcacaatcaagacattattcttctgagaaaatgttggaacaaactcttttaacttagacctaaggtaatgttcgtttaactgaacgaccatcttgtctaatatctttgtgtttttaagcataagttccacgaataaagtcactctctttgaccctaaattcgaacgggatttattccaaaagaccccatcttttgatctccaacattgattcggattcaagccttgcaagtccaagtagttgtcaaaacacctaccctacacaacagaagagtaaacatggttcttggattattagaaggaaggtagttagaaggtaggccatgaaaaaaatcaaagaagtttgtggtaaatataccggcatgatgttgccatcacttggacgaactgtcaccgtctttaaatcaggtgagttttgtaaaagtctttctataccaggaataacatactgaaagatatctgtctcaagagtcaaagcttttgtcttgaacatcgggaaaggaagaccgcaaacctcggcaagagataaaatctaacacaaagatagatagtcaacaccaaaacgcatattgatgagtaccattagtccattagtaaacttatatagcatcggtaaacgttgagtgtgcaaccaacataagtgaagtaagtaagagagtacttgaagacattggagaatgcaagaatgagcccaaaacatacctgaagaatgttgcacccaaaaataagcttctctgcattctgcaacttctctagcattttaagaatgtcttgaagtaaataagcgtcgagggtctttagatgtgagtaaatgaaacagtccacttgagcttcatctaaagacgagacatcaactaaagcacatggtgactgataggttttcagtctgagacgatggatatgcggtgccacaatctgccttggcctcgtattgtcaatgttgcaggctatttctaatgttctcaagcgcagcgatttgctaagatcaagaaccgtaaggtagatgcagtgggacaatgttaagctttcgagaatcggacaaccagatagaatcttcgcaatacattcatcagagagctcacaaaaacgcagggacaacttcttcagggacgtccaagatacggaacatctaggaatcatattaaataactcaaaagctgagttgcttaatagaggaattgatgtagaagaaatcaggaagattataactatgaaaaaaagtactactgaatgatagattctccacgttgcgggacatggcgaacttgatccacttgtcgaagtggggaacagtgtgctggttgctggttttgagatgaaactttatcatcttgagagctgtgtagcgagttagggtttcgtttatcgaagcagcatgcagtgtatcactatcatcaaaggaaagagaaggtatatcggaccatacatgcctccatcgtttttacaagacggaagttgtgatcgagagtttggtcggaacaaataataggatttgttggaggatctcatcaggcaataagctgattaggtcaatattccggcgatgacgaccacgatcgttacagtggataggaagactggaagtggctgtggagctctctcgggccatcttactttattaacctaacttgtgatcttcttaattagggtttaaatcttaattttagccgcatattgttttctatatataataacattctttcaaaatacatgtcaaacaatttatagcaaatttaattaactattttttttaaaaagtcttccctaataagtgctcttagaacaataaatcggcatttaaaaaaaaaaattggcattttatttttttcgtttttttaaacttattatatggtgtagtcgggctatactggacttttgcaaaaatgtggtttttatattttatattgtattaggtttctgttaaaattaaatgagaattttaattaaaaagagaaattatttgttaaaaaaaatcaggatggggtcctaattattatatgttttgattttctatgagaaagttgcaccgtccattgtttcttgaaaactattatctgactaaaagaacagaaaatgtaaagaaaagacaaagagacacagagacgactctgttaaataactctatagcagagtctctcgagttaaatcaataaaataaagacctgaaaacatatatttcttcgaagcagtgtctaaaaccaatgtacaatttatgacaaaaggaacatgttattttagtcgcatataattacaaaataatcgcatgatttatctaagttggtctttattaactcttaacaaaaaaataatataagaaaacagagtcagaatttaaaaaccacttaattagtccttcaagaacaattatcaaaaccttaataatgttttcatccaataacatcctcgaagtctcctctaaatcattggatccaacgaaattcatgtttatctaaactaactcgaataaagaaacgattataataattgcacactatgaaaaatatcagaagcgtcatagaaattgtcggctacctccatgcacggaaccttcacgaaacagttggtccctcacacacttcatcgccacgctataccacgtgtcaattttacatacaccaaaacatatctactaatcatacctcttcacgtgtaacaaagtcccattcaacgtggcaattacagaccccaaaattatgaactaatcaaacctcttcacgtgtcgcaaacttgtagaacgttgaaaccccccactcacacgaagtgtatatatcctcttcacaacacaaacataaacattacttcaaacaaagacttgaaagaactatctttgttttcactcatatcttatctttattaa

SEQ ID NO: 621 - DNA, 3000 bp, Arabidopsis thaliana
gttttcatacaaacaaatgttgtcgaccttgttttattattatattgtttgcttgatattcatcgtttttatagggcggtgccaagaaagttataatttctgccccttctgctgacgcacctatgtttgttgttggagtaaacgagcacacataccaaccaaacatggatatagtctccaatgcaagttgtaccaccaattgtcttgcccctcttgccaaggttggtaatgttgcacaataattttaccctcatttcattgctatgagattcattaaggtcaactaaactgtatttggcaggtggtgcatgaggaatttggtattcttgaaggcttgatgacaactgtccacgcaactacaggtctatataacttactctcctgctgcagatcactgaatgttgataacctgattacactaacctgtgtgttttggttattttttctttcagctactcagaaaactgttgatgggccatcaatgaaggactggagaggaggtcggggcgctagtcaaaacatcattcctagctcaaccggcgccgcgaaggtacacaaaaactcacatggttatcgcaagcatgtaattatcctaaatcgggaatcatatctgagctgtggttttttgatcaagtaggctgtaggtaaagttcttccagaactgaatgggaaacttacgggaatggccttccgtgtaccaacatcgaatgtttctgtggtggatttaacttgtcgacttgagaagggtgcctcttacgaagatgttaaggcagccattaagtatgcttcctaaaattttattgcccgaccagatatcgtcatcgaaacattatcgtttaatgtagaactcttaataacctctcatggtttaatgtaaacctctaacaggcatgcctcagaaggacctcttaaaggcattctcgggtacacagatgaagatgtcgtctccaatgatttcgtcggtgattcaaggttggtctctctccttttcttcatagtcatctgaatctttttttgtggttgaccaatgtggtgattccaatttggttataacaggtccagtatctttgacgccaatgctggtattggattgagcaagtcctttgtgaaacttgtctcttggtacgacaacgaatggggttacaggtacacttttgtttctcatcttatatttctcatcctagctaacagttctaacacttaaaaatcttctcccattttacttacagcaaccgagttcttgaccttatagagcacatggctttggtagctgccagccactaaatacacacaccagttcttgcagaagcttgagtctttctgctttttgcgtaacctgctctacaaagccggtttggatttgttcggttcaattaggtgccactgtgctaggtgttttgaaatatttggcttgaatctcgagcctttactctatttttgttctgttccagtatcagcaaccatgatttggtccaaaagactgaaaaactgtgcgacttacatctatgaataaggggctaagctagttgtactttaccaaaaatagcttaccagtataagcaacgtttggatacttcttgatagcgcatcgttagctttgcccgtgcttatgacaaaagatcactaaccactgaaacatattttttacaaatgaaaacagaaattgaacttgattagcctgtgtaaccatgtttcagaagaaagcttactcgttttttcatccgacgaaactcgtttggtattggcgattcctggaagggaagcatgaagatttatccattgagatggacaacctcatcatctatctcctctgtcttgtttctgatctctttcaaaacttgtttgtcttttctctatcatcaccacttaagaaaaggtggctgtttttgagttaacggaagtagactcactcaagtgaggctatagctaaggaaggacatgagttatttattggccaccatgcggataaggagaactcttgaagtaaggttactcatatattttcacttgccccgatatttcatggaaactacaacattttccacgaactattgtttattacatatgttttctaagactttatttattacagatatcgcctgaaatttcgtattattacaaaaacacacgtaaattttgtcaattccaaatatctccaaatttttgtttgttacatattgttccctcaagtttttgtttattacagattcccctgaacctctcatggtttgatgtaaacctaaaacctcaaaatcaaacaagtttgtcacagaaagatatatagtctccaatgatttcgtcagtgattcaaggtctctcttctttctctaaatacgtaacaactaacacggaaggcatttcattggctacaattatttcaaaatttatcttacaaaaaaggataatagagtgtgatattgttcatcagagacgtccacgtaagggtaaactaatcagtatatggacaaaaaggtacttgtttatctacaccaggaagaaaaacaataccagttttccggtccacaacttttgcatcaccatgcatccgcagccacgtgtgttcttatgaatattaaaatctacttatttcgttatacgacaaacgaaagatactgctttgttgcgtagacaaacaaacaaaatctcttgataataccagatattcttaattaattagtacgttttaaactcaacatacccataagaaaatccagttagctcatggtttcatgttttccaatagatatatgtgtatataattaaacgctttgcatcgtttgtgatttgcatgttggaaataataatgttttttttttgctaatcaaggtttgattaaggaaaaggagtttggactttggacctttctactacaaatacatgtggccctttttggccaacaccaaaagttccaaaaaagaggccaaaaaataagcaacaacttttgattctctcgtaacttcccccacaaaatcagcagagcgagagcgagagcgatcggtt

SEQ ID NO: 622 - DNA, 3000 bp, Arabidopsis thaliana
tgcatgtttacacaaattaagtaataaacccacttcccactttgtggcttttgctttaaccacaatcatcacgcttttggtttgtggtcactgcttcggctgctacagtcactcacaaggtccacaattattcacgatcgactcgactctttgacaacgacgtttctaattataaccctcgtgatttaatgatatcgctaggacaatgttcaccataaaaacttcaacatataaacaagcaagtggttgtgtagtactacgtataagctttcagtctttctatcaatagttgaatcttgcactctagttcaattattcgtttggaggagttatgatccatggtccaaagatatttatagatcactttggtctaaaacttcttggttaaacaaaaaaaaacgttgaaagatatacaataaaacctctataaattaataatattgaaattgcaaaattttattaatttagagaggtattaatttattaatttatcgataaattaatatttattaatttatacagagattttcttaatttagtaacttttttaaaaaatttataagatttttttcattatagaaaataactttctagaaccagttacaagtataacataataataatgactaccaaaaaacaccaaaagttttgatacactaaaatatgaaaactatagtcaaacaaagaacaattatgaatttaagcaaaaaattattagaaaatatattttacagattttttttacatataatatatataaactaaattttatcccgcggtgacaatttatctttttaaagttagtataatttttttttgcaaattgtatctatctataatatatttttattttatagtttacaattgttattaagtaacgtcctgccaaacccgttccgtaaaaaaaccatttatttatattaatgttgatcttatttatgatatgtttataaatcattgtctaaatttttttgtcgatgcgggacgttgaacccacacattttttgctaattggttaatatatgttcatttttaaaattttgaatcataaaatatgacggaaaaaattaagatgttttttaaactctatatattatataatgatgttaaaaaattgtaatatttcaaactatttataagtttaaatattaataatgttttataaattctaaatatataaataataatatttaaaaaattaatatttttgtttataaggtaatgacacaataactcttaaagcaaggatttagaagatttaaatctttaattaaatattttcattaataaataattaatgtcagtgacatgacattataaataagttcaaatacaaaatttatttatttaaacaaaaaacgtttagtaagaataatatttatttaacaaaaaactttgttttaaaatattgttaacaaatatgtttatgctaattttaagggattgatttgaagtttggtgggattaaatttgattgataatgtgattgacaatttaaatcaaaaatttaaagtaaaattaattattttggaaaaaagatttaatgctaatggcagtaaattgtaaataagtcgaagtccaggatttatttgctaaaatgtatatatatatatataatacatttatacaattattaatttatgatattgatgggatcatatatttacatagcactttcaaaaaatttattatcttattaatttatcgatttgtgtcactttttatactggtctcaagttcggaccggaaaaatttattaatttatagaagttattaatttataaagtattaatttatagaggttctactgtatatcatagacgtatacgacatagattagagtataaaaaaaatacacatcgtcacctatgatggaaacttaaactacatgcatcactgatcacttgtaaacatcttcgcaaaagacttcacagcaaataaaaggttttgcaacatattcttcataacaaacaattctacttgaaccataattatagtgaattttttcttacatctacaacacatgtacagaaaaacgaaacacactaattaatatgttagataaattcacgtgtacaatatagcaaattgcattttcttggaattccattagttacaaccttcatcgactatcgaacgattcaaattacattagaatttgttctttgtttcatagatttatgtatcaacgagttgtcatttcacgcaaaattttgattaaatagttcatatagtcccatcgaacttgattttcatattctacctatattaattagtgaaaatttgaaaatatctatcttcacaaaatcacaataccttaaaaacctagttgaattctattgactattttttagtaacgtttatttacattacatgcatctagattttatccaaaccaaagtgcaaaaatggcgaaaaatattttaccatctcctgtggtaaaaaaaaaacatttaccatctccagtacaaagtaagtcaataattattgttgaaggacctacgcactactactaggccctagttcaaaaattggtctctcacgcgccatcacgaaacgtgacaccacatctttgccacgtgtccatacagcttccaaacaacagatcgcgcttggcacccacgcgtttctcagtggccaaacgatgtcgtttaactgcagtgtcccacgacaacaaccgcttcttcttcctcatccctcgggtgtcttcgagtgtgttcacagatttacaaagaaacttgtcttcacgttaatcacgccacgtgtctgaacccaatttccaacgtgtctctcacattctcgaattcgactcttttagtggttctcgtcctctctgggcttttagactgggctcgaaccatctccattccaccgataacatcgaaacccgccacgtgtcctccctcctctgtctctcgtctatatatccacgctcttgttcgtcgattcgagatcacacacacaaccaccaaacacaaagcttttcaaaacccagagaaa

SEQ ID NO: 623 - DNA, 3000 bp, Arabidopsis thaliana
gcctagacggagttttttgtactgaccaatagagaatggcttgcaagagggaaacacatgatctgaaccaaaagtatgtttgtttgtacacttgaagcgtatttttagcatacgtttgctcaagcagggccaataattgacaataaaaccttcgatccacgtgatttggattgcgtgttaagaggtgcaaaacaaatcttcgtgctcacattattcgggctattcacttcacatgcatttgactatgacaaatgacaatagttctttttaaaaaacaaatcaaaggaataatacgtttattagacttcacaatcttgctataatggtccctcttcaaagcttagagaatttgtaagataacaaattaagattgattgtatttgggtaataatgactacctctttttggctttttcatttatataaatacttggagttcacctccttacaacaacttgaaacaaatcatggagcttaactcctacaaacatggaatcatggaaaagtgactttagtggaatactccacattattagcaatgaaacagaaatgcgagagacttagtcaagtcatgaccaagtccttaatcgtatcttggattgggcttgcgcagacgtttgggccgaacgttgatgttgggctgaatgtcctcatcatgctatgcctcataactcattcctcaaagctttcttctaatcataatttatttgttttttgtttttttaatttgcatcgtgaggtcttctttttgatccaatcaatggacctctttctaagagttcaactactcttaacaactttaggtcttctagacacatagaaagtaataaatatatatgggcatgacactaaggtttcattctttttctttattgtggtttaggtttttgatctaattttgttattgtaagaattattttgtaattttgttattatcttaccatggaattaagaaaaagtaaatttcttcaaacttaccctgttgttgcaacttacatattaaactctctcttttttgttaaaaaaaggttatatatcttttaaccttctaggattttagcctagctgaaaaaaagttacacattaaacttgtttttgttaacaacgttttagcatttcggttgtgtgttgtttcttccggttgttatagtttcgtactttcgttggttttgagttttggattcttgaaaggtggttataatttatacattttgtttctacacgaccttaaagaagtaacttcaattaattaaatctaattcgggaaagagcacgtctcaaaagagtcgtcgagtcccatgtgaattctatatgataacattaaacaaaatcacggttccatatttgtttaatactagtatgtattgcagagtagactttcctaatccagtagattcttaaagaaaaaataatataaaaagattgaaaatagaaataaaagatgggagacacgaagggtcacttgtattgtaccgagtccaaatgtaaagaagtctcaataatggtgtaataaaataaagaagttgaagacaagatcacaatcaccatgtgaagatcaacacacaagatcataattttattgtatgtttgcttcatttcaacttttttaaatattgttaagagggcaggcattgagtgcgccacgtggcaaatgaccatccctttgtaggtgcagcaaacgtgataaagattccggactgttcacccattcccttcttccatttgtttcttattttttcttacaaatcttatcgtatcataattttttttccataatgcgctcccttgaatggaataacgttggttattttgtttccaaccaaattttcataccattcgatcaaataggtgcatcaacttacaagaaatgaaagtgtgatccctattttattaggtagctaagtaagtgttagtgaacactacgttagattgttactcaaataacggatcaacgaatctcgtattcattactatactgctaatgaatgcatcaattttaatttttattggttatctatccttaaaaaaaagttataagaatattttgataatttgttccaagatgtagtactagtagtagtacttggtctcgtaaacgacgacgccgtttaggaaatcaaacggccaaaaatgcttccactttgcgaaattttattggtgggaaacgcaaatgtatcgataatgatttaaagaaaaagcggcgtttctaattggaccacgttgcccaatctctacggctcacgcacgatctgacgtcaaattggcataatactataataaccttatcgagaataaaataatagtcgcatccaaacaaaagaaaccaacccttttatatcacgacgagtgtcacgccatggacacttgtccatctctctcgctctgacccctttcaggtatcttttatttctcaaagaggaattattgattttccatttccaaagaaaaaaaataaattcgaaggtcaggaaaattaacaaaaaacttcctttttttttttgttagtttgtgtgactgagctgcttcattttttttctttctttttttttttggtttgatgaatcgatttttgttgtctattactgattggttttcttgttcagattcactgattcgaagagaatcatgatttttttttcccgctgaataataagcatatgattgggtgttttggagatttgtttactgattaaaaggagattcctttccattttcaccatttgctctgtttgacttcattgtgcttatatttcatttagatcttttgtttgggtttagctttggaactgataaaaatctgattttgtctcacggctttggatttggttcttaaattttggtactttaaaactggataaagatcagtgcttttttagattcttcgtttgttgatgaatttatggatgtatgtataattaaaccataatctctctgcttgtttgttttcttataggtaaatatccagaagcttgatcctcctagttgtacgaaagcttgagta

SEQ ID NO: 624 - DNA, 3000 bp, Arabidopsis thaliana
tcttcctcattggattggcatcttatcatggaccctacttgtcttgaataagttggatcatattcatttcatcaaaaaaatttcttttcatttcatcgtttttcagatgtatttatttatacatggtatttatggtaagcttaatgatcacttatttattttcacaaaatcgaggttttagtatcattttcgaatgacagtttgtgctattttagccagtagatcatcataattaacagcctaaacattacctgtatgtattttcatatacattaactgaaatttaagctttacgaagaatgtgcatatttataaatctgtgaatatttcaaaagctttacacgcggcaaggccaagaggttggaagaatatgcaaaatacaaacatgaaatgacaaggcgccttaaaaataataattaaacaaatatgactttaaaaggctctatagtcttatgtatatgttctgttaaatttatccaaattaaatgagccaaaactacgtttagtaagtattagaaatcatagccaagatgtaaatctaattaaagaggacgaaatttgatttcttaagttttatttctcaaaaccatattactagtttaatctttatcattaaacagaaccagatttctcttagacaaatgaaagaaaaaatagaagtaaagaatcatcttctcttacgcatcttatcaagaactgctacatttaagctaacctcgacacgtgataacatttgtcggacgcaattttcatacacagccacaaagcaatcaccacgtcatcttctcatcaacttggctttcttaatggtgccaaatggcaatgagtcagtggttgatcttgacaactttgattgctacttgtctgaaatgtctacagatctgattcattacattgtataccaaaactttcgtccatttccttgttgaaataagtcgatgtaagtcattctattcaaatattttttttcatgaagtaattttctggttttaaagcaaagtaatagattatttataatttttttaattttaatggcttaaggctaaagtgacgttggatcgatgaagccgccatagttcacaaatggccgaatttaatttgttgtttgtatttaataagtcaaaagagatttccgagaagcaaggtgaacgtaaccttaaactaatcattagaacattaattatataagttgcgtttatcattaatattgttgcttaaaattacaaactttcaaaatcccatggttaagataattagtgtttcagagcctaagacggaacggaacttgtgtaattttgtaagaataaacatattaacttcgtgtctaaaaaaaaacatactacactgacttcgttttctaataagtaattgttgtagaattttaatttatttctgtttatgtaaactgttattttgtatgtttaatgcatatattttagacaagatacttctatccataatagttagcttattaatagaggtataataatctttttagatttcatattatatttagtactattggttttagaaaaatggaaaaaggtcaaataaataataggaacaccactggtttatatttcttttctggattgtgtatactttttagaagaaaactaaaacggcatgttgaaaaggaaaccaagaggatagtaattaggtcagattacttgtttagttacaagaaagtcaagaaatctcataattgagtttaaaactttaaacatttgcatggaagtcaataaatctataatccttactcgtgatcatcttattgtttccgtgtaacgaaattaaacgcgtaaaacatcgcgtaaactatagtacggtatgtgatatgcaaatatatcttaatttattttttattttttatttttcttgggcaatgaattgaagagttgcaaaattatttgccagcttaccacatgcggccacaattttaaccatgattaatcttcttttggaatttagcgagataaatcaagagtaggtttattttagaacatagtatataatacactaatgaaaagtctcgttaaaacgtgtttcacgtaaccgacctctaaagtatggcgtgcgagtaacgacaaatgaaatctcaaatgaaaatggagattattttaatcttaattataacacactaattaacacccgtcaaacatcctgatatgtgaacgtggaatctcgttacacaatcgaataaaattattgcttaatacgatccgtctttctctctctttcgtaatgattatctatcaatattatcttgactaataaaagtatcgcaaggccttggcagtcacatgttaaatgatgatatacgttgttgcatgttaaaacatagtacaacgatcatctaggctgctgctaaattctattttcaaaaatgccttttatatgcaagaaaagcaaaataatcgagtttttttttttgtttcattataaactgcttcatttttcttaggaacggccaaactgttaaaaagtaaaatatgtatggtgattaattgatgtaaccaaagccagttcgcccgtttgattgtcaacccacgttatcattcacttgatcacttccatgaaacatataaaagctgataatacttatattataaaggaaaaaaagtatgaaaatattatcagtagttagatgattagttcacatctaaatgaaatacgacttaaactgaaagagacatgagccaattcgtgtcgagccacaaattttggacgtatatttttagcccgtggttccacaatatttgcaggtctttttattcaatgagtttattttgtcttggttgaataatgaaatttccaaatataaaaaataatagaaatccgaggccctacacaagcacacatagtaactcccacattatatataagcggccaatatcagcaactcagagattccagaaagaaagaaaaaaaagaaacaaataattccaaaaccttctctcttaatcaaaatcaagaaacttacaagatctggtgaaaacc

SEQ ID NO: 625 - DNA, 3000 bp, Arabidopsis thaliana
aggacatctattactttagacccggagaattcctaccttcactctgtacttaactgtagatgcagcactggtaagagtctttctttaagctttctcagtaatcatttttgtctctaatctttaatgaattttgttttcttccatgtgcagcgtttctgattagtgtaatatacattgaagtttgtaagcgcctgaatgtaccaattgttggatctccagttggggaagattttctgatttggcctaaaacggagtatcctgaggaactctttaaagcaacttcaggacagagcttgttctctattgtcaatggaaggtgtgttgatgatcctggatcaatggcatcagacttaactgcaaaatcacttcaagacctcgacatggcaacaaacagagacattatagggattgctctagccaatttgattgtaagcccttatcacttataactaaactacaaatcattgactccaaaagatttcatattgaaagaaattatatattgtgccttttgatcattttcagaggcttcactggagacgtgcttctaagtcatcccatggacttatgctgacttctcctcttagtcaacttaacaacatcagtagttctaatttcccattgttgcggcctcaagatcttaggtaaaaacgtttttcaaaaaacaaagatcttataaaccctttagtattattctctgcctcacattcggtttctgctgatcgaaggttggctattgcggctgcagaaaggttgttgattttgcaacctcataactgggcacttcgcagagaccttggtatgatgctgtactacgacaggtacagtaaacttagatttaaatccttacattaagtggttctttgttgcttgtcccggttctgtgagtattggtctgtttagtttgatcaaatagaaaatcttgaattgttgagatatggtttattgtggagcaggcaatatggagaggcggtacaagagctgagcatatgtatggcatttgctcctcctgaagaagaagctgtgttggagccatttgtagaaagacttcatctccttcgtctcatatcttcattgaagcctcttggttctgatcgcttgaccgttccttgacttctctctctctctctctctactccacttgtaaattcactctctttctttctctgttgtgtgtttgaagaacctttgtagtaggagacatggagcttttgttgtttgttgtaactctactagactactactgttgttttctaatcagatctaatggatttgggcctccagctaaattttgagtttcccgtgaatccatatttcaaggttttatctatttgggcctcaacagcttaagcttatataagacgagccgattcgatcatggtttagtgacaactgacaagtgtacttgctaagaaccaagtaaccgaatgagatttggatttttagaaatgatttttcagttttactttggttcaaaccgaaaaagtaagccccgatcgcattcaattatccaaacacgataatcttgctcaattctactcttttaactttggtcctgtctgtttaaaagctaaagaagattggtccctaccaaaaaaaaaaaaaaagcttagaggatttgttttttgatttttttgctaaattttgcttagaggattggctgggactttaagataaagaaagaagaaaaaattacagttacagtttaatcaatcgacttaaatcatataaacttaatttcaatagataagtttgtattagtttagcttgaaaaatagaagtagtaaagagttcgatattatctagaaaactacaacgtaggaacaacacataaacatgtgaattgtgcatgcataaccccaaagagtggcaatatcaattatcaaatatgcaacacttgtaccattacatgtcattctatctttcatatttttgatgattttgcactttgaactctgaaccatccatgatccattcccttgacttgtaaaggttatcaatcaaacttaagtttttaaaaattaaatttgtagtcaagaatagtagtcatatatatatatatatatatacaaaaaacaaaaatttccccgacccaagtgaccgaaaataacgactacatgttttattcctcctttagtataatgcgacattacagtttggtatcagtagttttgtatccttctcacaatcacgattgttggtgtaataaactttattctttctatccaacatgttatagtttccacatttgtgggtgctgaaatttcgaccaatgtcactcgtagactcgtatacctaatcgagtttacttttatatcaacaactacagaccaagattcccatttcacgttgttgtttttttttgttttttttataaacatttttgttgttatcgctaaatcattagtagctagaatgccccgtacacggtcttgaaaaggagtcaaatatgtttttaccaaagaagaaatgtaagaaacataacatttaacaaaattttaaaatatattgactaacaatttgacccaaaaaaaactatcaaatttaataaaatacttttatgattatcatagtttttttccttttcaacaactttataatactgtagtggctcaaagaaaccaggtcggagaaattgttcacaaacgagataatatacaaattcaaaatatttcgatgaaacatttttgtcaaagttgatgaatagttttgcagcacataaaatacaagataattcgtctgatatttaggaaaataatattatcgtatgtgaaaataacaatatagacaaaccaatatttgtagattagaacttcacataaactacgaaccaaaggattttagtagcttcacatcaaagaataaaaatctaagtttcacaaagaaacaattaaatgatttttgattttgaaaatttaataaatagccccacacaacacactcatcttccttcacagccttaaacgtggagccaaagaaagtaaaaacaaaaggagagca

SEQ ID NO: 626 - DNA, 3000 bp, Arabidopsis thaliana
taaaaaacaaaaacggcgaattcattgttgtaaaagattattgtagttgccgacaaaagagaaaaagaaaacatcattactttaacaatataacaaagaaggaagaaaacagaataaaattgggtcatacgaaattgttagacgcggaaatagttgagattatgaaagaatggcatgttcatcaataatgaaattaggcaatctaaggactttgatcatttgtttcgcattgagctaatattaatcttctacgtttcctattttcattatacatgcgaatgttccaacaattctatttgaaaattgttaatgataagtgtgaaaactcctgcatacactgcaacgagacaacaaaggttgtctctggcattattcttattccttctcactccccatgttcttcaatatttgtcttttcatatagaaattatttaacattctaaacaaataaattattaaaaattggttacacaatcagtatagactatagaatttaaactaaaattttatgaaactctttacttccaaaattatgtctgtagctggcaatattagttttttatagttgagatttttcttttttttttttggaatgacgaaacccatgtggcgttcatttttgtaagttagaagacaaggttagtttatacaactaataatgaattcattattgtacaagtcaaaatatttgtatattcagtttcttgggcagtgcataaggaaatctaggagcgtctcgtggtttgatagaatacttataaaaatatacgttactcttactatacaaactatttttattccattatccatttttttaaataataatatagttttgttcatccttggattcacgtagagccaatgattgtcgccatcgtgcaacctccggtgatcaagtgttttgtacggtaggacccattcttttttatcttattcgggccatccatgcggatacataactttcaacaaacgaaaatagccaatacataacataatttagtaacatattatcactttttcatgtagtcactagaaatattaatagttcaaatgtttcgatttgaagaatttgatatttcaactgacatttcaagtataatggtgcgttaaccaggcaatttgatctaggttcctatatatgtcggtaaaatacacaataacgaaaatacggtactcgatcttctttttgcttgcaagtgttgtattgttgaaattcttgtggatatatcttaggccttgaatgttttgtagattttgtaagagtttttggattttgtttttcaaaaacttattttcataccaatcaagatgttaaaattttggtttccttacaatttagaaaagctattttgttgtagttttccattcatgattttagttttttagttttcctaaagtttagggaatctagtttttactccatcaacgttatttttctcgaaaactaaaaactaatttttagagtttttaaaacaaaaatatattaacaaaaatctaaaactaaaatctaaaatgtagaaactaaaatctaaatccaaaaactgaatcgaaaatcagcaaccattcagggcctgaatctaaaatcagcatccattcagggccttagtgtgtcagtaaaatgtatttattgataagtgtcatgaactctgccaaaagcgattaagtttaaagttgatataaaaaaaacatttatataaaaatgtgattgttggatgaaaatttatttgttgatatttataaattgccggattgcttaaaggatgaatccctttacgggttgtttattttcaaccagtatgatttgaaaatgtttctaaactcagacctatattacagctagatacttttctagtatacataaatattcgatctaaaagtaaatactaaatacttacctttgataaattttagcaataataataaggcattaaaaacgcgtaatttaagcgcattattgtaactgatatggtgtgttactcattaatacttttaaccatacgaagcaagtattaatttcaaagtagtgtgacaaacaaaaaaaggtaatagtctctactctctaataataccaaaaataacgacgatgtgctgactcacaattacggactttagcaagtcacccttttactatagttccaactgatatacatgagaaacgtgtacgtatttattttatcagtaatttacctgttttatttatttgtctattttctggttaataaaaaaaaaatccagcctccaaattatatatttaggttgaaataacactagattccacagcactagattatttttgagtaatttatttttagattggttcattagaagctggattttccaatagaatttaaacactttgatatatttttggaaacattaaccaaaacatttaatacaatttaagaaactttatacacatagttataaatttaaagtaaagttcataattataaattactataaacaaaataataaatgtaataagtcataacatgcatgttgtgtataaatgtcatgcatgatcggttaaaaaatggtaaaacatggaaataacgaattattttaaggaagagacaaagtccctgcttaagtgggagaggttttaggaaagatagctcagtgctgctagggagagagaaaggacaaatatggcatcttaccaagttttcgagtcaaacaaaattaatcattttctattatcatctttatactaattgtttttaaaaaaaattatgacatgacatgaacgacattgctccctcttgtcctctcttgctatgccttcttcttctacactataagaacacccacaacattccccctgcaactccctctctctctattactctctttatctctctaagaaaccagagaaaaaagacaaactatctctctttctctctgttcctctctttatctctctaagaaaccagagaagaaaagacaaaatctctcttatctctttctctctaagaaacaagaagagaagagaccaaacaa

SEQ ID NO: 627 - DNA, 3000 bp, Arabidopsis thaliana
ctaggttagagttcttgaatccttctcttgactctctatcccaatccttcacaataataaacatttttgatcatttagattatttaaaaattgcaatatataaaaattatacatattttgagaaatcctaacctgaatgtagagacgtgtgttccaatcttcttgagctgagacattacatctgagaagatctcttctagttggagccacattagggtttcctctccaataagcatacgccacgcggtctttccattgagtcatcttattcccttcttctatcgccactagcgatttatcccaaggctttatattaacctcagccctagcccaataataatataattagctaggtccaataacaagcccattaaatagagaacagaatagaattaacatgtgtgttaagcccttaccagccccagaaggaccaatcagggaagacaatatccaagctggcgtcatcagagcaataacggaacaaaggaggcggggccgggtgttgttgaccttgaaagtctttagatcggacggttggtctatcatctgggtcaaacatgagctcaagatccggtaacctacctgggtaccaccgtagtaactgtacgatgccccacagagtaaaaacgtctcttgtttggattgactttctatatttcttaacgtacactctcccgtcgaggattactactctgaaatgcgccgtcctcctggctttctcaagcatccctctcgttacacctgtctctttccatggccgtagatcttcgtggatccaacggaagtaagaaggacacgtggatattcttgaatggctgcttctgggtttgtcgttgtttctcgaggagccattttggggaaataattgagtttggttctgaacgacgccgcattggttagggaatctttggcttgtgattggtgattttctgatactagttgttacctgcttcagacctgtaaaagttgtctgaagtacagagagatatgaatttattaactcttcaagttcaagattcacttgattgaataaaaagtttctaaaaaagaagttacttcagattcgaactcacgaaatcgaaacaacccaataagtctaagagaccagcagatatgaagagagaggtgacgaggaacagagtagctttagcgatgctttttgctggatgcgacgccgttttaagatagacatacttattcttgttcgttagaagattgttgttgttcctcttcatgcttttccgttgaagcatgaatctatatctatctcagctttatatatatctatgttcacaaacattcaacaggaagagaagaaaaacgagaatcaggtgagattaaacgttaccgaagctaggaggaagctcaaaggtttgattctggtgatcgattggtgctcttccacgaggatttgaatcttgtttcacgttatcttcaacactaaccagagttcacatcttttgtgttaatgacgttcatatttttgtgtgaatcttgtttactttttagtttttcgaagagttaaaatgtttttaaatattaaatagataatattttattaattagtaggagacatttggtcatccatatttggtattcctatgctcaaatcacatatggacattgatatgtgatacacaaatgtttcccaaataatcgtctcttattaacgttgtatttattggtaaataactaaatacaagacctttgatgttcttagaaaaataatctgcttactacaaaaataaaactgcaagagttcaattaattaaagtcctctttgggaaagtttgttataagtgctttaaactgaataaaagaatccgaacttcgaagaaagaagaaagaagataaaccttaacccattaaataaaggtcagtgacatcatagtccatattcgaccactcatcatcatacaagacagataattaatcgtaaataattccatgttgtagagtactttttattattatacaaatacattaatacatctttcacaggctgttcgaaactgtgagtctgtgattagtgattagccttaattaatttactttattgctttgttagaaaaaaaattacacctttctttaaattaaaacaagttgggcaggaaatttaaaaacccgttgggccattaggattcacaaaagcccaacacctacaaaaagagatgtctccatctcatagtccatataccacatgcttaaaccagtttaaattgcatataccacgcgccacataaccggaaagttttgtacacgcgcgagacacagacattatcctttttgtatctgtcttccagcgtgtcgagtcagtgaggctccacgtcaccctttgatccacttaaattttaaaactaaaataattgtttaaatgaattcgagtgattgatattttattatagatttaatacacacccgacactctgtcaattctataggcatacgagctcactccaaatttagattcagttttttaatacgaactttttagttaagccaagattagcaataatatagatcatttattttcttgattgtagtttgattgttgtttttctcataataaaaaaatcccagctaaaatctgattttcaattttaaaccaatttatatggtaaacaaaattttagttcggtataattggaagaattaagttttgttgaatatcaggaaaaaagaaggggaggacaaattttctacagaggtgacgtggcatcattgaaccactttacttgtcggcagtgaggtgtgtttaatcacgtgtaacgcatccaatgcgtatgagagctttacagccgcacgatcacatgggtacaaaaatcaacggcgaagcaaaacaagagtctcacacttattaaacgcgcgtagtacgctccaccggtataagctaacggaggatataaaaactctttaactcattattgtcctaaaatctcaattttatccattttcacggaaaaaacataaaatctgttcttcttcttcggctgagagaca

SEQ ID NO: 628 - DNA, 3000 bp, Arabidopsis thaliana
cgtctttagccatatgtgttaatggatgtttctggactttctaagtaagtgttttgctttgtggttgttgtagggcttgtggttgtgagatgaagaataaaggttctttatatagagtgagctcttggtttgtgctactgttgattttgacacttttgatttaatgtcacaacttacaacattgatgttttgttttatggtatttttttttgtaacgaatgcataagttggtttagtggtaattttttttttttgctaaagaagttggtcagtggtaactaaaggaaatctaaaacaagtattaattttttttttatctcagtaacttgataatctaaatcagtgagaaccaatacaaaaaatctcctaaagatataatttaacatttcctgaaaagtttatacaaatagtataaatctcatactgtaattcatttccaaataactagattgttaaatgctactgatagatcaccgtcccaagagtcacgtcattaaattttgttaggcatcacccaaaaaatttgaccgttgacaaaaaaccaaaaaccgataaaacgtgagcaattatataagtgaacatatttgacaatgatgatcatatatacttgtgtgttaacatacataccttatcttttagctgtatccacattgcatatactgtaggtgctttttaagtttttgataaataatgattttatatgattagtaaagtatttgtctcgatcgtgtcacacgattcttttgtttttctgccgtttcaagcacattctggatcattcgtgcatctttttcatgatagttggtaaacatatagtatatatagtaagcgaatatttgtataggaaaatgaaatggtattttaggtcattttgtataataagttaaataacgcataaatacgtaatttatttgagacttaactttttcggtgtaagctgagtgttaaatctgtcataggacactacaatcaaattataactctatatatactccatcgactatatattgactcaacatatcatgatagaattacatatgagtcagatgtaattttatgatctgttattgtggattcattgttagcaagcatatatatacgtgtgttcagaagactaaaaaatttactatgaaatgaaagaacatttatttgtttggaacaaaaaatgtttatcataacaaattaacccatttttccacagagaacaataccattcgtaaccaatatcgagtagacaattctttaacaaaacagaaagcgacaaagatgaaagaaaacaaaaataaaaccaggggagagaccgagagagagagagcacctttctgacgtggaaatataatccaataagagcagagaaatgtcgctacaacgataaggatattgtgacgtggcaaaacattggccatgaacaccacattacaccacattccttttgtctatgtacactttttatttttccaatttatttttgtagacagactagtgattagtgaatactgaataatatacgtaagaaaattgcaattggaaatttggaattgaggagtgagagcaaatgattgttgaatatggggactaaacaacgtggcataagaggagtggttgggacggctgaactggagttggacttaatctgtatggacggtgccgatgcaattgacggagctaatcaattctatatggggcggtttctccggtccagtggacccaactttcatcatattttctactttagtggaaacataacccgtgaagcgacgccgtttcttttatcatgtccatgtgataaattatgtttttgttatatggtagggttagctgagagctatcaaaagactcttttttatccacctaatagatttgatttgtaacgttaagagcataggaagtcaatttaatcgttactaattacatgcataagaactagtataactatataaggagctccttctagaaattaaatgaaggatgatagaatctagataatcagaaattttactattgatcaatctagctatctcgtagttcaaaaagctttatcgttaacaagtaacaactttcaagtattgcccaaatagataaggttcataacttcatattttttatttattttatgtgtaaaagagtgacagtctatattattctagggggaggacaaggctcatgacataggacaagagaaagaaaaatatagaagcatatagtatattagggtcggtccaaatgaaaacaacgtttaggtatggggcggcgaggctaagttaaattaaccacaaaactccattatcaaccataattttagaattaaaaggtctctgttcctattgatagctccacaatcattcttttaaataatcagaatctcaaataagttcatctttagttacagatttgtatcaatagttgaagttgaaaccaaaataataataatttagttatagttaattttgtcaacaaaacaataccttaactatcatattatgacaaacactaattgagatgaaaaactcttagcagtagctaattcttactatcatcagttaattatactaatgtatatggaaattctgcttaaacaaaaaaaaaacagtggaacatgaatatattaagcaaaatcagtttctattgattatgtagcaatgattagattggtttagattatatatcatcatgacagctagctaggtaattaattagtgaaagaaagtttccacaaaaataatcataatcgtcatacacacaattctatattcatttcattgaaacgaataataaaaacaaccataagcctaccaaaaggaaaacattatcgtaatataatcaatcaataacacgtatacaattattaacgtatattgacaagcaaaattaatgagagcactcactatagctatagtctctctatataaacaactttcattcgtctcttcagtcttcacaaacacaacatatccacaatacaaaacacaactttcatatataacaaaaaaagttatagaa

SEQ ID NO: 629 - DNA, 3000 bp, Arabidopsis thaliana
caaaggtacttaatcttcttcacatacgaaaatcattttgcttgctatacctttcaatctatacatgaaaagcggtttttcagaccctcgagaaaataacaatggtaaaaaatatgctcaagtccgatggctttagttttggcttctcttcatccttctgtggatatacttacgaataataaaatctataaccttagctaatgcgtgaagccctatactgatcaaatctttcttgttatgggtaaatttagttcccttggtctgaaagttaagtacaatttgttacatttgcagcgatgacagtgaaagcgatgatgataatgtaagtgggtaggaggaaacatgttttcgccatctctgttgaatccattttgtaggagaggctcattaagcataatcccttgagtcgcggatgaaattgtatcatttttctttcgcatgagaatatagatacacagaggtcaatatacaatatatagatatacctgactttggattatcagatccttctgtgttctttgttgagaagcactcatctcattttttttatttgatacgggtacttcgattttgttaaatggtaatgtctcaaatgggttaaattttatgcgtctttagtttttgctttcagtctataacagactagattatactactaaatcttctaattacgttattgtattatgaatatgatttgttactaaaattcgtttagtgcgacattgtggcttcgtctgtcattgccttctgtgggtttatcttcgttaaggatttatcttttctgtttattactatattataatccccaccaatcgtaggattaaaaaggttgataaaccaatataatcagataaatttaattgaaaaactatctaagttgagatgaaaaaaagtaatggagaaatgcaatagagtttttttttattatgtcttcatacgtaatgccagagaacgtgaagaagttttcaagagtcaaaagcacacataaatcaaataatcgctggagacaaaaccctatgttaatcgtataaacgtttggtaagtttgaaggatgaaaagaaacgattatcttccaggagtagaaaagaaaatttttggaagctacgaggactagatcttcttgtgtagaatgacataaactatgctagtgagcaacacgtccttcagcatttgaatgaccgtcaaagttatattgtttaccagaaaagtgtatttaatcacgtggttagcggttcacttttgcggcagtttttaccatattttgactctagcaaatttagtggcggcaaaaaaccggaaccgattactcaaactggaaccgacccgaaaaattagatccgaattcgaagatttatcttatttgtcttaaatttctctaccaaaaaaccgaattcgaattcgacccgaatccgaaaatccgggtatttattcgaaaatttgggtatcgattccaaaaaaggcctgaaaatctatattcgaacccgattggacccgaaccaaaatcaaaccgatattttagaattactctattggatcctaaacttctctatccaaaaaaacctgtacccgatcggattttatcagaacctgactcgaatgcccatctcgcattatcctgcatagtaacaattggttttggatcggatcttgctgataacactctaattttacccattttttcataaatcgcatttatttttacccattttttcataaatcgcattttaaaaacatttaacgtaatataaaaacattttcactgttcatatgtccattcattttgtttttttctttgttgcgtgatttcctactatcactgtgattccgtgaaaacctaatacgattttactattgaatctgttcatctttcctttgttgcatatatatttttcctgtaatcacaaaattgaaccctatatatagtttgtagctttaacagtttattctctaatacgtagtgcaatataaattctatgtgaaatcggtacctcaaattacaacatatttgtttgattaactaaaaatacaaaaataaatggcgctaaaaatcacacagcatcaaataatgcctattattcaagtcgaattacgtattcagttgtgaagtagttgtagtcaagttgaaaataatttttatatttaatctagcgtgataattttataactatttgagtgatcgtccttgccccctatatcacattcatataaatgatacatcattcatgatctatcaactattgacttcatcgatacaaacgaaacgaaaaattacatttttcaaattattttaattccaaaaaagaaatcaaattatttctcctttgaatcgtgccgtcaaaaaaaataaattatttctcctttgtaagaacattaactagttcatataaaatattgagttggaaaaatagacatacaaattcatttaaaagaatcatatcgtcatatgcttgaacttgttctttaatgtcgtacttctatgtagcgatgtttaattaattgtttctcataaacaaatgctgacccgattccttgtcatactaaaataaacgattcaaacactaaacgaaatattataagaattttcttttttctttttttattcgtataaccaaaattaattgcacacaaaaactgattaaatatcttattaaaataaaaaaatcttctttaaaaaattaactttaaatatgttcaaaactgaatagaaactaaaacaaaactataccaaaacaaatttattaattttattttagtttgattactactgtttaaaaaaacttaaaccagagacctagaattttaaaattcagaaaacttcttttaaaacctcaactagaagaagagtaagtagtaccgcaactttttgtgatgtaacgaaataaatatgcttttttccactttaaatacaccaaagacactctcaccacaagtactcacttaagcaaacacgttccacaatcaagtaccctctctctatctctccctccctccctctccacc

SEQ ID NO: 630 - DNA, 3000 bp, Arabidopsis thaliana
tcgacctttcgagctttcttcatgaccattttgagatccattaatgtttatttgtattaaagccaaaagttgacaagaataactaattggattcaccaagtcactctcaagaatggttaaaaataaaataaaaaaaatcacaaaatcttgattcccataactaaaaagaaatgtgataacgagtacattaatctaccatgggggtgccatttcaatggaattctctagcactaaaattctatgtaagaacaatgtacatcctactcataaatcaaaaacctaaataacaataaaggaatgattagaaacgtaccatatagaccatcgtcgtcgtcaagcacttggcgtttgggcacgatggattccattgaagttgaacctggtgtgaatgatcacaaagggagaaccagagaacaattatattttatatatctaacgcgttttttaatttttaaaatcgtactattgaacccaccatgagattaaataaagaaccatggaaaggctaaacaatgaccgagttttattcttcaaataaacattatgatcttatgactttttatcttcattgtttatgacttagtgaatgttaattacagttgactaatggaattattagcatagttagtactttgaattttagtatcgaagcagtctcaaatcatagtcaacttaatatgaaattaacttagagaaatagtattattgtggcgtacatgacctgatcactaaccttgcgtaaagtattgaagatttattgattatgggtcgttggacggaaggacttgtacttgaaagtcttttctgttaatattgggcttagaggcccatcattttaaaggctaagaaattctttatatcttctattctttttttttttttcccgtcttatatcttctattcaagcgtttcctaatgttatttatccgaacagactaatcagtttgggccaaaatcgaaataacaaatcgtcacggtaccagtaatcgctagtgtatacgtgtcggtagtccagcacagggatgaacgaagcatgaactaacttttccacgtgtcatatatccattacacgatctatgaaagctggggtattcttgtaaatataaattatcctgagggcactttcaccaaggtaatcgttattctgcttcccgttttttttatctttttccggtaaatttctgctctaactttttttttttcatcatctttttggtttcgccaataatggaactcttcttccaccattttcctggaaaatctcggtatcgagaagatgaatccctagacagataaatctagaatcactcaaatctctgctcttcttccgattcagatcgtatcgaattttgaattttgtatctcgctacactgttcgattgagaattctttttttccgattgattcgaatcggattttgtttttttcctcgatatagaatgacttcgaatcaacgtatgttgttctactcctgcattgcgaaaggaacagtgattctcgcagaattcgcttcaaaggaagagccaggaatcgaagatctagctttgagatgcattgagaacgtacctccacatcattcgatgatctctcacacagtccataagagaacctacgctttgatcatcgatggattgttttcgtatttcgcgattttagatgaggtcgtagcgaaatcggagtctgtatggctattcaatcgattgaaatcagctacagagtctctaatggaagacggatctactgcggattcgttggataatccgactcaacactgtctccaatcaaagctagatccagttttcgctgagattgctgctattggtggtaatcataataaggatttggaattggagtttggatcaccgaggagtatagcgagggagattaagagtaataatcagagtttggattcgtccaagggacgaaaaggcggtgcgttgatgccgcttttaggaaagccgttgagggtgttgaagaacaagaagagattgcagacggaagcgaaaagtgaaggtcattggaatgagaagaagatggacctaggaggaggaggtaaaggagtgaggaatggtttgattcatgatcatcatcatagacaaaaggcaaaacagatatggaggaaacatgtttggattgttttgatgtttgatctctgtatctgccttgttctctttggaatctggctttggatttgtcaagggtttcaatgcatcgatgggtaattatcttcgatcatctaagttatgtgtggttgaatgtttaaaaaaaatatccgaggtgttgtttccagggtttaaaaagaaagcctggtttacacgtttgtgatgatgtttttgtttgtgtttttttgaagttgttcttcatgaggtaaaaagaaaaaaaagtgtttgtaaaaatctcttttgtaatgatatctcttcgttttctttggatgttttgattacacttgatttgttgtgtgatattgggcgaaagatgtggtctatgcagttcaacgtctacgaattttaaccccaacatgaccaaaacactcatatttgtagttcttagatgtaaatttttactgcataacccatcttttccaaaatgtttgtcaaacgtaaattagcatttttgtccgcaagatacaatgactttagcatgaaccaaaagggaaataaatctcaatcaaccaccgtattaattattttccgaaattcatatgtgaatataggagttgtttagcaattcagaaagaaatactaatcaaggtttataattacagaaatctggaaatgtatgtcggtcacatcagaaggaaaactgaaagagatatttcttgaatcttcttcttcacatatattttgtcacattgtatagaaaaagattgttcacttccgctacttaacggtcaagacaacgaccaaggccaccaggccccttcacttcttttatcttcgaaaaccaaaattttcaattatttattctctcctccactcacacgaaagtagcaaaagcaaa

SEQ ID NO: 631 - DNA, 3000 bp, Arabidopsis thaliana
acctaacattgatcctttctttcctcacactcttcttctgaaactcaaaccgctctttcgtagagagattcgtgcaaataaccttccaaataccaaaaaagattcatcatcaatgatcaatccaaggtaaagtaatcgattttgaatgatactcacaatcctaatttctccttttaactcaattacttgaaaactaaagaaaagaagcccttaattgccaaatttacaagattagcgtctaggactatctcaagatcatccaaaaggtaagaaccctaaacaacaatttctggaaatcgagtaacctaacgctaggagtgaataaagaagcttatttgtttgatacctttggtcgtaaatcaagtgaagctgaagaaggtctgaaaatagaagccatggaagagaatcttggattaggctctcaacacaggagcaagagtttttttttgtctttaaagtaatgatttcatgttttttattttctttattggccaagaaaattaaggagaaaaacaaaacctgagccactcagccacataatcactgggaaaatcaatttcgtattgtctcgaaaaatataattgtttcaacgacaacaaaaaatcaaacatgcggtgtggtggcaaaagtcaaacgtttatttaatgaaagtttatcagagaatcgatgggcctagcccagtccaataggtgattcacgtctcactatttttgcagcttcacaaaaatggtaagttggtaacttactatttcgagcgaaaataactcagtaataacttccagattcgtcaaatttctcttaccttgtaatgaagtttagatgttttagctttatgtataaaaatttaagaatatggtctaattttatataattttcttattatcattttgtatttgatatcatattgacaaaatttaacaaatagatattagttgtacttctatgtgaccgccactttattcaatactaccttttaagttttaacagatccgtgtagcaactgatcatctcaaaatatgtgacacatagtatactatacaatatgagctggttttgttttttattttatatcgaaagatattttactttatctgacagctgcgagagatcctaaaaaaaatgaattaactttaaagaaattgcatgcgtctatctatctacgtatatctcaaaaataaaaataaaatcaaggtcacatgactcatatccagtgaataaaaaatattcatgaaatcgtaaataaataaataaaaacagaaattcatatatacgtttttagttatataactatacgattggttcagtgtatttgttgcccaaccaaagctactttcacttcacatatcattacatggtccaatgattatggaacacgtattattatttttgtttaaaaacaagtaaataaataaaacagacaccaaataaaaaaggaaacacaaagatatttacggaagttaaaagagaggtgttgtctatgtcagtgcaatgaacctcttcggctcatcttttcccgccatcccaactaacagatctctcaccgtacacgccatcctcttcaccaaatctaatgactttctctctgtctacgtggcgatcatccggtctgttttccgacaataatgggacccatttgattgttatttcgaaaatgattttatttttcttcaatattgtttttttcttcaatattgttttggaagtaaaaagaatcatctgttgacaacacaacacttcttgccttctcgagtttgattctcctcctttctgtttttggtatccacccgattgtcattattttattttgaactctagaaccaaaaatatcagagcaagctctctagtcagtaaattttgtaattattatagtacctcatttttattagtagcattaatgtactagtgtggtcagtgtagatgaatatattttctactaaactaataaaaattgtatcataatttgtatattttttggtgttttcatcttttactataaaatatatttttgtgacatatggcatgttacactaaacaaaaaataaaataaaagaaatttgtttttgtataaaataagtaaattacgttttttgtcgaccaattttgattaaagctcaaaagaaaagagcaattcctaagagatattatttttatgtgaaataagtaaattactcattatgtaaaaagtttggatttatcttaaatctaatttcataacgtttaatgcaagatattttggtaaaataggaaacgtataaaacatctgtattcaaaacttctataaagatacccaataataatggaggggtgacacgatagtaaatagaataagaaataaaatttaatcaagtcaaaataaaataaataccctttgtttttgtttccacaattccttaagtctttctaattactttgttgttcactaaaacatctcacattgtgctattttttttaataaataaagacctctctctttaaaactgattatcccctaaactatttgtttgtgagaaagaaagagaaaaaaaagtttttttggttggaaattaattgagggagagagagagttcagaatctctaaatggctgaaacgaattgcccagaatccaggaaactctgattttagtccttttttcctcgggaaaacgtttgctttttcttttttgtgtgtgtttggttctttaattgacaaatctctctctatctgtttcatgtgctagctaaggttgtcttcactttcctctaatgagtcatgagtttcttgtcttcatcttcatctaataaagttaacaacactctcatcaatttttattatgttcaaatctgtctgacttttcgttcttttctcttacacccaagcgttttaacaatctaacatctgtctctttgaatacttagatatccaacttcaatttctctcctttctcttcccaactttgattcctgatttgggtttttgttaaagttcaagaaagttcttttttctttttttttcctccttta

SEQ ID NO: 632 - DNA, 3000 bp, Arabidopsis thaliana
taggcccaatggcccagaacatagcctactattattgggcctgtagcctgctttagcatatttaccaattatcacgtgtatgtatgtatgtatcatctgtccagagaaaattgctaataccggcgatgaatcagctgcagcaactccaaaacccaggggaatcgccgccggtgcacccttttgtagcgccgttgtcgtatctattaggaacatggagaggacaaggagaaggtgaatatcctactataccgtctttccgctacggcgaagagatccgtttctcacattccggcaaggtaaccatatcagatctccgattcatttttaaccttaatccaatctgcataccaaaatcgcgatacgcttactctgtcactttgtgtagccggtgatagcgtatacgcaaaagacatggaaattggaatcaggagctccgatgcacgccgagagtggttactttcgtccaagaccagatggttctattgaagtcgtcattgctcagagcacaggtctcgtcgaagtccaggttaacataatccaaatttccattagatccgtgtttaccataagcttccaaaatcattacttatgttttgctgaatctctgatcacagaaaggaacatacaatgtagatgaacaatcaatcaaactcaaaagtgatcttgtgggaaacgcttcaaaggtttcagattaattctctttgttattatttattcaatgtctctgtctctacacacaacatttttgtgtttctaattggtgatttatggggttttttttctccaacaggtgaaggagataagtagagaatttgaattggttgatggaaaactatcgtatgtggttcgtatgagtacaaccactaaccctcttcaaccacatctcaaagcaatactcgataagctttgaatccaagttcctgtgaaatcgaaacctgacacgaccgatgtgatattgagatgctttgattttgatatgtagaatcactctgtttagtaacaacatttgatactctttgtaagattttggttaccaaagtgttttgttatgttttgttcttgtaagcacaagtaagaagaagatgacaatttgagagttaaatgggcttttattaaaagaggtaaataggcccattggcgcctatatacgttcaattttagcatctgacgcctcaatattaatgatattctaattgactacaatagctttcaataattacaagattgtccccatatttattttctttttatactattgcatacacattttagaaattatgagatgagcaccgaagttattatcgaagcaaagtcaacaaattgaagtaagattaattctctacaattatataagatttggtttaataattgtaagatgcaatcttataaacttaattagacatacgtaatcacatataacaacagaaattttaatacaaaaaaaaaaataaaagacggaaaagaaaacaaaagaaagaaaatcatatagatgtgaagcagacacgtttaggccacggcaatgacaaaacgtggcaccttgtaattctcttaagctccataattttggcttattgtattaaatagttccatatggtgtttcttatttttttttggcctatttggctttttatgtggtgttgacaattataacttgatccctaagcaatatctactttggatataatacaaatggagcaaaaacacaacactttcatttttgaagaaaattatgtaaggtgattgtgtgtttattagtagtcccaatctaatagagagaaattaaattctaggagtgatcattttctaggatagttaaaacttatggatgactttcatatgagtttagatctggattttggtggggggacataagaaatatagatgcatatgtaagtgtacacaaatgaatgggccacttgacacctaatgatacaaattttcaaagaaaactcagattgcaataatggaagcatatcaatagtagtatgagatctcaatctacaatcttcaataacatttaaaaaataaaatccaacaacaactgtagcgtataggaattgttcatctcttttcatcaaagaatatttaaaattttgttagacaagaattaattaatgatttatatggttgagaaaactttttaaaaagttgtaaaactcatcgaataataaatcatttttaatggaaaatatagtttttatttttattgtgtggtattgctcggactcaaggatacatggagagagaggcagagtcaaatccaatttttcaactatcttatatgatattcttctgtgctttttatagtttgcccgaccataagaactggtcctaactttcattttttttgtttccatagaatatgtattcctatgatttttttttatagaattaattgtgttagttaatgccaaattaagattctcttttttaaaatcactttttgaagaagcacttacaagagagttgtgttaagaatagattccagatggaaaagttggcaagaaaagatgttttaagtttttgccttgtcgtctaatccaacggtcgatcttcgttcatatcaagaatccttatgacgtggaccattctcttccctccatctgtacctcttcccaacctctattttttaatttacatcgaaaataaataagaaggattgcaaaagaaaaaatagaaaaaaaactctctgttcttctttcttcttcttcttcgtcgtaagccattaccatttcttctccctctctctgtttttctttgttgcgtatctgtacttagttttcaaacataaaaataaaacatatctttagctgatgttgtcttcttcttgataaacagattttctacagctttttttctttctaatttaataattcttgagactttttaaaaccctctgcgaaacagatgattcgagttttggtttcttcatctgtgttttgattttttcgtcttttattcttagtcaaacacataaatttcttttactactcttcgtag

SEQ ID NO: 633 - DNA, 3000 bp, Arabidopsis thaliana
tgctgaggaaaagaatggagaatattgctgtagcacagggtcttgaaggtgtttcgatggagtgtgctaagacgttgaataacatgttggatgtatatctgaagaagctgatcaattcttgctttgatttggttggagcccggtccacaaatggagatcctgggaaacaacgtataggcaagcagcagagtcaaaacaagattgtaaatggggtgtggccaactaacagtttgaaaatacaaactcctaatgggtcttctgatataagacaagatcatcattctgtgtctatgcttgattttagaactgccatggagttaaatccacgccagcttggcgaagactggccaactctccgagagagaatttcattgcggtctttcgaggaacaagactttgaggtgtgaaagacatcttgagcatgcttgttgatgttacatattgtccaaaaggggacaactaattttgaatgcaaaaagacttactgtgtagttccatgacgaaccggaaagagacgaagttatgagttctgagctgaaaagcacatcactatgactgcagcagcagactcagagcaggttagtagattattaaaatggaactaatctcaaagaaccgtataaagatacgtgttgttggttgtcatgttgtaagattagaagtaattggcaatctcaaagagttttgagctttgtgtgtaaacccgaggcaaataagggaattgggtagagagtttttggcagagatactgtgcttttaagttggtgcaaggtactattgtcaatcatgtaatagctgcagtttgctctgtatgtaacctagtctttagcattgtttagaattcatatcttaataacaaatttgacatccgcttttgttttctcattacaatggaaaatttctttctctcaaagtccacaatacattgcctcattccttactttcgactagtggttgtgtcctgtctattacttatgccttggaagtagactatttgcaagttttatttatatatatggaaggtattgactgcagggaaaatctctgatgttgtaagctatagggatttattctgctctcagcttctcgtccgatccatgcattaaatgcggtggtctcttgtcgaaaatcagtcgagatcttttgcttttcctgtttatggtgctcactttggatcgtgttttcttctagttgaaatataattatgggatacatgcttgtgttgtgttacatatgccatgagcttaatggttacaatgctagttagaacatgtttgtcctgtaaatcaatgttaaaaatatcaacgccgaagaagtcttcttctggcaagtctcactctttgctacagcctacagtgcatgtttgagtgatgaagcaggcagtttttctggtgagttctttgggatatgcataagaggctactctagtgtgtggttcttagacatgatactggcatgctcaacacttcactgcacaacttatggcatactttcaacaagtttcgatatgtaattctttgctctgtcttcagatgaactgatctttacatgttcctgcttttctctttacagaattcaaacaggaaaatcggcgaaaaggcagaacaaaaacaaatcagcattttgcttatgagcaggaagaagatgtcacagaaaagtagagcatgctacatgtgcttacagtgtaagcttccaacttcatcttctttttgtagaactacagagatcaaaacattgcaattaaatggattgaatacttaagatctgagatttaggaattaatttaggatctcctttttctggaacgttctactttacatgtaattataacaaggattaggtttcgtttgagagaattatccaatctggaaagtgctttagaggctaggccaatggggtttaccagacctggtcaagcccttccaaacctatgcctctcttctttatggtaccagctctttgtttcatcgatagacttgatttgacttgtattgttatggccatatgggatattagaatgataggagaaagggatgaaaaatgttgcatttggcgattagagtcgtattataacatgatggtgtcaccggataaatcttcgttttcaggtacattgataactcttcttgagtgagctataactagttcctatcccgtgatcagtgaaacgagaagacgccaggtaaattacagataatgttatttctcaagacctgacatatatagtattagataaaccacatttgggatgttctacttcttactgtcttagaagcttaggcaagacaaaccagaaaaagtggaacttgtgtaactaataaatccataactagctgttcttgctaatgaaagtatcagagattcataatatcctaaacccaaaacatatatgttacatttcaactcagaaatcttgtttgatcctcctatagaggctctggcaaaacctgcacaagcgtaaaaaggatcaaatacgtcccaagtaagaggaatataagatccgaaaattgtgagaagagtattgagattggttagtaccttgcttgttgaatctgtaactgcaatgtctaagtcacaatatcataaccagaaacatcttcaactattatattagattgaatatacgaacaaagtcttgtaatagcaagaggagaacatgacttcaagaagatcgaattggtcctgacataatgttaaacaatgtcgtgttacaaaactgtctctggaaacagtaactgcaattataactatcttgaaaattgtctctacatagatacacacgtaatctgagaattgttggctccaaataaccacaaacgtggactcatgtgtaaccactagttttctcgagactctcaaccatccaccgtcccatgtcgtaattatgcgaatgtgaccttttatcaatcaagatccaactacattcatggatttgatttcttttcccaaactttaacattttatatctaaaaccatttcatcttatgaatatcaacaaca

SEQ ID NO: 634 - DNA, 3000 bp, Arabidopsis thaliana
aaacatgtacattagtgtttaacacaaagaaaaagagaaaaaaaaatctaaaaacattggttagctaaatacaacaagaactaacaaaaacgtttgtcaacggaaacactccaactttattggagacttgacaacgcaaaacaaacagaagcacaacagagtacaaggcaaaacactcaaaacatatgatgtgatgaaatgaaagcataaacatgcaaatagcaaaacacacacactcacacacacaaagcgacgtcgttttctagcatctgcaatcacatgctttccatttcagcactgctctctacattatggcagcaataacagacacttaaaccaggaaaacgagcatctgagcattcgcctccagtaaaattgcggcccaatgaattgcattgtgtattgcaagagaacaacatactacataaacccgctgcgctgtcacacactctacgcccatctacttgtgtccagtccatatatagaaagatgcaacatttcattaacatgtatttattctaaatcttcttttaactaaatttacgtacctgtaggagacatgaggaggatggagagacatacaactactgcaacagcaaatgtgctcactcttaagctccccattgctgatttctcagttcttttttttttaaaacactagatatctctcaattcttctttcttttttccgctttgtgatttatttagcgaaggagtctgaatttatagcactgaagggaaaatgagaggctcaaacatgtaactttattttattttatttatttatgttatttgtatttatttttaaagaaaacatcactatgcaattttatattggaactaggatttaacccgtggtataccacggagcaaatattttatttatatatataataatcttaaattttaaggttttaaatttttagtattaaaattatataattttatattaatattgtaaaaaaaaaattagtgatgatagaataataaataaagatttaacccgcgttatatcaatgcaaacccgtcccactatataactcgtctcataatattttaatatctttttataaggataaatattaataatgttttataaagttaaaatatatcaataataatataccattaatgctaatagatctctttaaaaaagaatattagtgtgtagtacattttagatttggaaagatttaaatgattgttgtgatatatttattttaattctaaattttagtaacaaaattgatttatatttggatttgagaagaaatttgttaaaatattaaatgctaatggcattggatggtaaataaatctcaacttgaggatttatttcataaaagtgctgcaaaaatgtatatgtagatgagtaaatagatcaaataactttcagtcaacatatttacaataaaatgattctccaatattgaaaatcacatctgtcattagcatcaataaaatcgaattttattatatagtatacgtaacgagacacacattgagtctaaaatattgaaaatactcactatcacatatgtcaacgataacactaatttttttttttgtataatatacgtaacgagacctgcattagatctaatttttaatcgattagagcttaaatgacatcgttttggtttgactaagagaatcgttaaaaatgttagaaaatctgttaaagcttaataactgtttgtttgttttttttctttctttttttgtcaatcgaaaattagactattaaatgacaattttccgtttaaaatggcaagtcctagatttgaaaaggtcttttgaaatctttttaagagaattaagggtgaattaaatatattcagaaattaaagggtcgaattgcaaactttcttggttcatacttggtctgcctttgtccctttcttatcttcttcgcgcgcttttgaaaaaaatagaaacccgccactgaacgtcagtcttccacgtgtcctctcctgtgctctgtttccgatcgtcggagacatcaatttgcctgcttgtagggtgattcgtcaaatctattatcaggttttaaatatactcgaattgacttccaaattcttagtctctagtgtaatgattttgagaatcacttaactccaaaaatataatccacgatcccgtgttaattattgaagaatcaatcgtttttaatttctcaccaatagatgttgctcttattacttaaaacaaattgtttagacaaatgtagcaagtgtgatacttagtgggatcttaaagacgatttctcctataacagaggacaaacaggtcggtcaattacaatgtcatccctctttaccctgtctttttttttcttcttaaaacctaaccatttgattgtttctaaaggtatttcaagaatatatgatcaatctagatgaatactataccgacgatgactacacacacaaggaaatatatatatcagctttcttttcacctaaaagtggtcccggtttagaatctaattcctttatctctcattttcttctgcttcacattcccgctagtcaaatgttaataagtgcacacaacgttttctcgaagcattagaatgtcctcctcttaattaatctccttctgattagattctcaatagagtttaaatttgttaatggagagatatattgggaccctcaaggcttctaattataccacgtttggcataattctctatcgtttggggccacatctttcacacttcattaccttatcaccaaaacataaaatcaatcaacttttttttgccttattgattgtgttggatccctccaaaattaaaacttgtgttccccacaaaagcttacccaatttcacttcaatcttaacaaataggaccaccactaccacgtacggtttgcatcatacaaaccacaaactccttcttcattacaattattatatcatctactaaaacctctttctccctctctctttcttgttcttagtgctaaattttctttgttcaggagaaatata

SEQ ID NO: 635 - DNA, 3000 bp, Arabidopsis thaliana
gacgaatttgtggtgcatatatagtaaacgtactatggtctatgggcttccaagcctcctatccaaatgatatgatcacataacccattatttgagattacttcaagcaataagtggtgttaggggaacaatgatttaacttggtttccagacaataccctaaaaaattcagccaattttttttgtagtttcttgcaaagtaacgtttttatgtgttataaataaaattaaagaacaaaaaaaacaagacatcaagcgtttgagaaaacataaaactctaatttacataaatgagataataaaattattttaatttttctgtttaaagaaaattaggaagaggacttaaaaagttaattaattagtcgctggtacccattgcggccttcttagtttctcattttatttttaatatataaaccagctgattgttttgtatgttgtacgctattcatcatatatacgaacaaaataattattcaacaatttcagaaaacaattgcagctacagatcgctattttacacttagaattgtcttcttaattaataaccattttccaatttatgtttttaagttcatttaaaactatatatatatatatatatatatatatatatatatatatatatatatgttgaagtttgtcatttttggaagaattgtgttgaagtgggaactatttaaacatttcattggtaaaaaagggtctaagaatcatcgatctctatatagattaggtgctaccatctacaaaattttagaagagtctaaaattcagaatggaatagtcatcactaaatcaattatgagtgtcgaattaattatgtagtccagattttgcttatctactataagtattgtcgaattaattatgtacaaatgtagagtgcatatatagactatgcatttagaaagcataatgccttttgtttttgttttctctctttttctttttggtaaaccttcgtgatcaccttatctcttttaaagctttaaccaacatgtaacttggcagagaaaaacatactttagaaaagaccatatataatatacgtttagaactcattaaatagaagtctacctatttattctctaaacaaatattaaaatgatttaaacgtcaccaacgatatttatcgcaaaagtggtaaatttctgtcaattaaaatgtatttttgaaaaaaaagtagaaaaatgttattaaaataaaataaattcattgaagaattttttgaacaagtttagattatggcaatctgttctttacctcattgtcatcaaaaccatatctcttaatttatttttttgtcaggatcataagagcattatacgctaattgaatagcgattgatgagtttcttatcaacacattttgcagttatgcgaatcgttgaaccaaacttgtcgtatctttgctgatattcagaaattattatcttacaaaagaaatgggtgggcatgtccatctctctgtgaacaagaattctccacgttcactaaaatctaaaaatccgaaaagcaattgaaaacgatttgtagagaataataataattaagaacaaaaaaaaaagaattatcaagaagaagaagaatcgagttctttgaatcgcgtcacatgtttatatataaaaaggcttctctgacctgttcagcatggtccaaatattcacttgtcaacttcttaggccatttctagtatttcttgagtgaacgaaaccctaattaacctctttttgtttaaatataaactaaaatatatgaaataagtcttttatgagataatcattgaaatatatataaaaatcgaatttagttgttctgacaaaacttgaaatttatcctttaatcaaaaacaaagagactacttgctacatttgtgagataatcttaatggtataatacaaacgatcatatattctcaaatgttattatctttaactaaaaaatattaaaatcatactattagtgttctgtatatacgtgtcttatgttaacgtatcttttcaatttattttagttagaactttgtagtttgtacacttgttcaatattttctgctgtttttattattactttttcttcttttttgtctcttttgattcttttatattgaagtcttgcctaactctcccaacacgtgtacaattcacacggacgggaaaatgcattccacgcgtgtctgattaatactcttttgttcataaaaacgtcttagtgccatttgttttactcaatagatttatctgtcaaatagttagtgcttcttcttttctttttctgactccaatctatgtagtgatcgagtgcttcaggacaaactaaatatcgaactggcctctaattatttggagcattttgatacacatcgttgttaggcttttgatcaaaattctagaagaaaggacaactggcttaacacgtgtcgataaactttagcttttcctgacggttcatgcacccgaacggcaccaatatagtcgaatatagaaataataaagcttcattgctttctcagtggaaaaaaacttactataattagaatatttctagtaaatatttagacattttacatgtcacgatggaataagaaaaaataaattactgcaatcactcagcggacttttctcataatcgtagtacacaaatttcttactcatgagaaaattttcctcgtgttttttgcacatttatatcgctggaaaatattgtacaacacatcgataaggtcggccagttcatagacgtggcagtatctaaatggttaaacgggtccacaaagaaaatcgtaattagattttagaacagtaagacaaggacgaccgtacttatccttgaagaacctttggcttttccgtagcctatataaaccaactacttactatattgtccaaaagatcgacgaacataaaaacaaaaacatataatttgggtttttagagttcgaaacttgaaatctttttttttttggttgctgaggaatcgaagtagaagagtataa

SEQ ID NO: 636 - DNA, 3000 bp, Arabidopsis thaliana
tgattcatgtagattattggataagatgggcgttattttggatcatcccatccgatgttgagttaaactaatctgagcttacaaattattaaagattataaagatctctatgttcatatctatccaatgcccaatggaatcttttaaaaaatataaggaaaaacattatcttctgcatattaaacggataataacagcgaaacttgtggatggatcattacaatagaaaaataccgaggaggcacattcaaggaaggtattcaatagggcaccaaatattgtaaacgtaattctctaagtttcccatacatcatatatctgctactactctacacgcatatatatacaaaatacatgtgtgactctcttatatagaccatacttttagacattatacttacataaagccagtactagatggctgtagattctcgaattaatagtaccctaacattctttggaagaacctatgaatctttcaattataaaatagtgatgctctggtgtaggctaagtgatacagatgaagttgtaacctcctatggcaacaataagcactttcattacttgaatttgtatagaacaccctatagctatcaggaggatcaagtaaacaacatttacggattcaccttaatattttctgcaccaatacaaaatttactgaagttgattggtctcatttgcctgatcaaggctgaatccagtcatctccgctagttcagcgagttctatttctccgcttaagacctaatttataaaagaggtgaaataggtactgacatgtgatgaaatgtacaaggggttcagaggatttactcaccttatcatttattatccatgttgggaatccttcgatcgcagcatctgcacatgccttgagtatcttagttcctttcttatatccatccggaaaacattccacgtagttcagttcttttgccgcttctcttccaaacatctgtagatggatggaactataatgaacatataataaaagcataaaactgattcttggcaaacaggtgatgaatgaactaactacctctttttgctctaagcagtgagaacaccagaatgccccatacattttagctccaatggagtttagatgttttgctaaagcaatagcataagggctcgatgatgaactgatctctgttctaaaatatggcagttcaatgtcaccagagctggaaggagtgaaacaaaaaacgatcgggattaaaagagaccacctgataagactcatacatctttcggaagctatttgttcactactcgttacaaatgactaaaatttctatcgggactccccaaagaaaactatgaactttgattaccgtgaagggattggttgagcagtactgtaagaagcagtcaaggaggcaactactatgattgctaagcatatctgcaatcctacaacttgctgtatttcttgcaacttcacatcctaccacatgcatggagcacattatcataatccgaagtttagaagttatcttgagtcaacatcaggaaaaaaaaagaaatggaaataaagggatacctttacagagaggaaaaatagactaaatgataagaaagcagacaccagacaatacaggcatgatgatcctgagagttttgtgctaaggatatacaggaaatatgcactagcagatgccattgcagtcgtgatcccaaataacgcgaaacgcccattgctcttactgattccaaaaggtagattcccttccccaagctctgcacttagagcggttactacgccatacataacaaatccaatcactggaagaggaacacctggcaaaatgtaaaaaaggattttcattgagttcaacttacctgcaatgcaatgttggacaaacaacgaagacaaagcactacatagagtggagtgaagcatgctatttaactctaacaattctatgcatactaagtaccaaagctcctaaatgatatagcttcaagcaaagattcacagagactatcacatgcgagtatttaatcatgcctactataaaagagaggacaattagctacataaatcaaacgctataatcaataaagcgatggataataccgaaaacgacggcataatcgctgttgaggacatcaccgcaagtgccaccaccaatagggcaaaacgcatcggagccagtgaccttgaggtaagtcaaatacgcagtgtctaacatcccaataccgccgattccggtgtaccagttgtatgtcgaactgttactagtagatacttcacttgtagacgatgaggaggaggaagacagcgacggtgccgaatcctcaccgttttccggctcagatgaagaacatttaatcggaatcgcaggaaatctccgatcagagacctaattcagaacatctgacttcaaatgaccgatcacacactactgtcactgaagaaaacacatgacaagaatttacctcgaatcgtctaggataagaagttaccgacggaggagaaacctcacggaagccgaaatgaaactgacaagacgacacagaaacaaacctcgccatcatcgtcgtcgaagaatcgctattccaccattgttaacttcatcatcttctctcctccgctccactatctcagccacttgtttcaatattgggcctaaacgaggcccaaatacgataatttggatccataattagtttatcacaattgggccttacggtcttcttatccgtccgagtcagcaagttatcctcttcaacacgactcacgaggcaccgagttggacttatcatgattcattatctacgcattgtttacattttggaatcgactttggtacataattgaatttatccatagaaatgatagagactcgaagatcggacataaaacttgctgacgtgacacccatacctttgtgtctgtatgtattatataaacgctatagaactaagagaagaagtatctaagtagcatcaaagcattctaaaagaagtttcaaagaagaagtgaaa

SEQ ID NO: 637 - DNA, 3000 bp, Arabidopsis thaliana
gactttgtttgtaaatgtccgaatattttttcaagatatttatgtatttggtacttcaaatctagtacccaagccttagatcattaaaatttagaactcagtatataactaatgccattttttatttttggattcgatatttttttttttagtgtaatattaaattatatttaaaaaaacaaatatacgtttttataatttgtgcttcgtatgtttgaaaaagtaagctctaaagatttctgatgatttttcgaaaatgtttaaagaaaatgtttaaacaagctaagagtcgaggttaactagtcatgggagtgaatccagttttaaataggcatcgtcatactgcttgtcgcctaataatcgtattgctgaaatcagatttcgaatttgtttatcaacccatatggtgataccctttatattatgatcccacgcacctcaaaaatttcggcgttggattcatgtcactcctagctagcaacctcagggctcgcagtatcccattcgtcttaattagttaagattttttttaaaaatttattttgttcagttattattcatttcattcgaacgattaaacaaagattattatggtctcgtgatttatatgttgacccttctaatattctaaatttaaaaataagaaaaaagaggaaaattgaggcaaaacacatgttgccgagtcattatcaactaggggtgcataatgatggaacaaagcacaaatcttttaacgcaaactaactacaaccttcttttggggtccccatccccgaccctaatgttttggaattaataaaactacaatcacttaccaaaaaataaaagttcaaggccactataatttctcatatgaacctacatttataaataaaatctggtttcatattaatttcacacaccaagttactttctattattaactgttataatggaccatgaaatcatttgcatatgaactgcaatgatacataatccactttgttttgtgggagacatttaccagatttcggtaaattggtattcccccttttatgtgattggtcattgatcattgttagtggccagacatttgaactcccgtttttttgtctataagaattcggaaacatatagtatcctttgaaaacggagaaacaaataacaatgtggacaaactagatataatttcaacacaagactatgggaatgattttacccactaattataatccgatcacaaggtttcaacgaactagttttccagatatcaaccaaatttactttggaattaaactaacttaaaactaattggttgttcgtaaatggtgctttttttttttgcggatgttagtaaagggttttatgtattttatattattagttatctgttttcagtgttatgttgtctcatccataaagtttatatgttttttctttgctctataacttatatatatatatgagtttacagttatatttatacatttcagatacttgatcggcattttttttggtaaaaaatatatgcatgaaaaactcaagtgtttcttttttaaggaatttttaaatggtgattatatgaatataatcatatgtatatccgtatatatatgtagccagatagttaattatttgggggatatttgaattattaatgttataatattctttcttttgactcgtctggttaaattaaagaacaaaaaaaacacatacttttactgttttaaaaggttaaattaacataatttattgattacaagtgtcaagtccatgacattgcatgtaggttcgagacttcagagataacggaagagatcgataattgtgatcgtaacatccagatatgtatgtttaattttcatttagatgtggatcagagaagataagtcaaactgtcttcataatttaagacaacctcttttaatattttcccaaaacatgttttatgtaactactttgcttatgtgattgcctgaggatactattattctctgtctttattctcttcacaccacatttaaatagtttaagagcatagaaattaattattttcaaaaaggtgattatatgcatgcaaaatagcacaccatttatgtttatattttcaaattatttaatacatttcaatatttcataagtgtgattttttttttttttgtcaatttcataagtgtgatttgtcatttgtattaaacaattgtatcgcgcagtacaaataaacagtgggagaggtgaaaatgcagttataaaactgtccaataatttactaacacatttaaatatctaaaaagagtgtttcaaaaaaaattcttttgaaataagaaaagtgatagatatttttacgctttcgtctgaaaataaaacaataatagtttattagaaaaatgttatcaccgaaaattattctagtgccactcgctcggatcgaaattcgaaagttatattctttctctttacctaatataaaaatcacaagaaaaatcaatccgaatatatctatcaacatagtatatgcccttacatattgtttctgacttttctctatccgaatttctcgcttcatggtttttttttaacatattctcatttaattttcattactattatataactaaaagatggaaataaaataaagtgtctttgagaatcgaacgtccatatcagtaagatagtttgtgtgaaggtaaaatctaaaagatttaagttccaaaaacagaaaataatatattacgctaaaaaagaagaaaataattaaatacaaaacagaaaaaaataatatacgacagacacgtgtcacgaagataccctacgctatagacacagctctgttttctcttttctatgcctcaaggctctcttaacttcactgtctcctcttcggataatcctatccttctcttcctataaatacctctccactcttcctcttcctccaccactacaaccaccgcaacaaccaccaaaaaccctctcaaagaaatttcttttttttcttactttcttggtttgtcaaat

SEQ ID NO: 638 - DNA, 3000 bp, Arabidopsis thaliana
ctcgtccggattgtcctgatgaaaatgtcctcctgtgtctcctactgcaaaacatactcctaattagggtggctctttgacgttttggtttcaatgatgaagagaagagcgagagatgcttacgttgaacgtggataaggacacattgtggagcatcagcaacaatattttcaacggcccatttcaaggcgtgttggctgttcttgtccttatcaatggcgatcgccgtgatactgccatagtcctccgaggtccttctaactcttcttgcagacatgttagaatcttgcttcccaagaaacatgaataacctgcttcacaaggaaactataatactcataaatgatctcatgtcttctttgtcacaaaacacccacaaccaagatcgattgtgttgtttttcttttgtctggctttgcaacctcagagaagaaacaatgaacaatgaaaagaaacagaaaattgtattgtgagatgatgaagcttttagtggttttacaatttttctaattttggagggtttatttctcaaacaactcaacagtcttgtgaaacaaacaaacaagaatggaaatttccacaagtctcaacttatctttaattagagagtgatttttgggaagttgctggtgagatctagtttgtactataatgtacgcgtttcgattaaaataaaattcgattatacattatcaaaatattaaatcgattattttatcttaatcagtaaaacaaagtttttagataaaaatattagtaaaactagtcaaacatatggtttagtcttttaggtttatatagactagaggttgaaccaaaaaagagagtaaaatagactagagaatagaatgttatgtttaaacatgatcacacatctcaatttacacacatttacttaatttgagtttcgataataatgcaacagcaatatatgtatctacgaatttgaaatttatgagtacaaaatctagaggtgtaacaaaatatttattattttcgtccctgatcaatcagagtagccacgtgggcgggtggtagaaatcgaaattattgcgattattgacttggaaaaaaacaaacacacgttgcattttttgatttacgtatccaaaaagaacaaagaaaaaaaggtaaacgaccaaataatataattttctggggctgtcgtcttccatctttatttcttcttggcgatatcaccatatcttatacgtctctcgaaagattattactcttaagacgattccattaaacactgattgtgagaacttgtactttaacgttatcgaaaagtatacataaatatttttatttttttaggctgattcattcttactgataacaataattttgtgttattctttcttacctagagagttctatagacaagttcgtaactataaaaccaatctttatttcttactcatagctttcaaaactaaaacttgatcagtttaaataaaatatatgggaaatttttgctgaaccaatatattacgtgtcaagatttcattgatcctattaatacaatttattcattttacagttatatcaaatacaaattacaactaagatactcacttatctacacgtcagattgtacaactaagatactcacttatctatatctaattttcgtggttaatattacatgtcaaaattttatggaaataattagtgtttttctactttatataaatttttatgatatattttttttttaaaaaaaggaaagagaaagaaatcaatttccatttgtaaacatatttttggttctgaaaataaataaatgggaaaaaaaggaattaaataacatctgttgttgttagctgatcgacaggtgttgcctgaagcgaccttaaaaaaagaaaaaggacaaaaagttgaagaaaaaaagaggacaaagttcacaaaatgatacaaagactaatacgtgtccttttattaatcctcttttgtaataaatactcttttttcctataaattatattacaaaaccaaagaaaaaaaggaataaaaaaaaacagagagaaaaagcaaaccacacaatattctcttctctctctctttgtttcgctgatagagagagcctctctctaagcaatttagctcgagcgagaaataatcctgagggaagaaaataaaaagaagaagaagaagaagaacatctttacttttgttctctctctctcttctgttcgattttaatttttttgcagatgcgaatatcttctaaagattcatcaactggttagttctttctctcttcttttttctttcctgatttttttatgttgtttttctgtgtagttagcttttcaatcggaagatttttgctattatgtgtcgaatctctcttgttgttttgagctttgtgtttagttttgcttaagaacaaagtttaaattcatctttctatttctgggtaaagctaaagcttcttttttaatttagatccaaggaaacccatgttctactatatgattatggacgttaatggttcgaattttttagggctttcttgtgattgatttcgctgattttccctcctttttctggtttttgtgtgaattttctttgacatgaccgtttggataatgattcgtgagtttttgattagtgctttgtgatctctcaatagggttgaaatcaagataaggatttgagaaaagatcgacgaagttgttgcgattttgggatcaagagagtgatataatcgagtgaggagaattcgtcgtatagattcgtcagatctggttatctccggtacttaattctccttgattcgtcgttttaactatgctaagttagtgtatgaataaagcggcatttgggtcgctgacaaaaacttatttggagcaaggattcttcaacatcatgaaaccattgcttagagtattcgaagaagaagatgaaaacaattgatttctcctaagtccatctttgaaatttaaagctttgttgtggtgtggtgtggaaatctctgattttggagagctc

SEQ ID NO: 639 - DNA, 3000 bp, Arabidopsis thaliana
tccaaatcgagtgtggtaattattcagtggaagtatataccggctagaaaaaaagaatattctgatgaggtaaataaaaataaaaatgtatatatgatccattgtaagaaaccaaaagatcagtacaagtgcaacactgaaatataaatatgattcaactaccaaatattactgaatgtggaattatgtcaagcgcaggccacattttacaacttttgtttcttctctgaattgtgtgaatgacaataataaaagttttcgtacttttccgagaaaaatataaagttcaaaacttagatggataatatttatgtttgataaaaaaaaagaaatggacatgagtgcatgacaattaacttttaagaaataaaattatagtcagacaaatgacgagatttttctaatttaatttagaacagtgataacgaaatgtactacgcaaccttgcgaccgagtttcatcaccatttgttcttttccaaactactattttaatcctctgtggatattaactctttgattcatttaaaagtcgaattgccgtatctattatgattttgttattttggtaatattagttgtttttatattgatgaaaaaaagatcaacagatttatattgcaagaacataactcacaaaagatacaattatatgaattcaataagagaaaaacaatttaaccaaactaattatgtaatgtaataataatatttaagaaaaactagtaatgtaagttgaagtcggagaaccagctggctaaggttcggatccttatgcccgaagatgacatggcacggccgtgcacgagtggtagcgtctatttctttctagccgtagctcgtagatgatgatttgccagatagactaggatcgtgacctcatgaaagacgacgagtcgctaccttttttaattatgcccaaacttattataaacgtgatattttcttcttctgttatttttttaactaatgggatattctcttacgcaatcccacttactaattcattaattgaccaactatataagtatgttatgaccagccggaagtaattaaattacgaatgatgtcgctttgtgaggactatgaggcgtttgaaagtcctttacttttacaaaatgacgtttggttaacattgtagggtacttgtaactaattgtgtgttttgtatattaaacacaatttttgcgttggcatacatttgaatattaggctgtttttatctgcttccttcaccgaacaaactgttatacgtcatctgtttttctattttcctttcacaaagtataagaatcttcttcgttatctgtttatttgataacgaaactggcttatacaaacatgacacggcatggatcttaacaattattagcgtctcaagtattgataaaataataataacagctacactcacgactcacgtcgcctaaatcaccacattatcatttttggtactagtatccaaactgttcggatatgtatttacagtctttgtaagagaatttcaatcatttatagctgaaggtgtaccatatagatagatagggacaccagcaatttttacatataaaaaagaaaaaaatatcaaacgatttacaatgtatcatgtcgcgattgggtcttgctgcctcaagaatagggctgatatctcgttttgtccaatcaaagaaaaaacacgtcatattcttattttgatgatttatatattagcattatccaaagtccaaagattataaactgagattcatcttctcgcccttgcacattgtagcaacgtgtgaggcatgtgcgatgcctatacctacaattcacatgtgatccggtatattaaaatatacatgatttatggatacactcgaatacttctccgatattcatttcgcggaaagttgcatatgatccactatctcctatatatttgttatataacacatggcaaatctctctatatatattttttaaatacacatatatccaaaataggcttaactataacacaaagacttttgtttactgtatattagtaagaagtaaatgtattttttaatattatgataaagtttgtgaaatcaccatttgcaatagccatatagggtcgtgttttaattttacagtttgtattgttataattcgattccaaggttgagaatatgtgtgtactattagactatacaaataataattcgttgacgatattgaatatttactaattataggaagagaaaattatttactaactatagtacgatatatttcttctatatgtgtttttaacgtttttttttttttaaatttaagtcttaactttacttctcatttttaatcaaaaggaaaaaaataccaatcaatttttcctaacacagtttacttatcattttcatttgaaatgtgttcactttctgataaaatgctaatcctacaatcaaatacaccattgtcgtgataacacgtgtacggctctaaagcaatcagaacaatcattggacagtttttacaccgtcagataagtacctatccacttgctgactcagccggataaaccctaaaccggaagtttgccccaccgtcaaaattggaagaaaccggacaaaagagaatgtaaagactaagaagtaagaacccatcggacgtcgtaagaaggttaattaacacgtggaaacagctggtcagagttatccggtaacttatccggttacaagtaaaaaaataatttgttcccatacacgactccttcagaaccaaacgcgacatcacggcgccgtttagtgtctataaatagagcaatcggtcgtagaaaaccaagacatcaaaaacacgaatatcgatagtacacttctacgtgcaattttctcctttctcttcctggacatctgtctgtttattacattttcttgtaatctctttttggggttttacaatatctatcccctaaagtttcggaaaattctgtttttctgttctcattcttcgtgatctttttcactttcttcaaaaaaaaaac

SEQ ID NO: 640 - DNA, 3000 bp, Arabidopsis thaliana
taatttgataactcattacattttgtaagaaagctgaaatttttaaattgagggactgtacatagaaggagtatggagtcagcaatgtttatcgtgagaaaacaagccagatttttgtatattcttaaaaatgaaaagatttttctatattgatgtataaccgaattcaccatgcatggagataaaaagggtggggcatatgtggtactaatatatcattcaagatttttcttatcgtcgcattattattgtggccttattattttcatcatggaatgacatgtgacacattcaaagttggcatagattccccaaaacaatcatacttttggtctgttttggttttctatctcatgttgatgatgaaatgactcagattctattttattatacagtataactttatctaaaatgccattttacgacatatttttgttttcgaatagtttaaagtgttttgttagtatgtaagtttggtttgttgtagatttctgtctagagtacggatctctactgatcacagccattttgatgtgatttacaaacaaatattttttgagtcatatatcaaatcatacatcttgacataatttgtatatatgattgaattcaggttggatacttgctcaaataatcaaaattttgttctcattttactacgtcgtgaagattcatgagttttcaactccaatcgattggattgaccaatatcttttatatagtattacattattttctatcatatgactaatatgaaattcccaacagacacctttttttttttgggcaaaatcctaacaagcatatcatatatttttctcacaaagaaaatataagaatctttagtatatcctttagagttaacataacaaattcgattctataatacgactacgtgttgaattggctatggttgggctatgagactagtgggattgtcccacataagcttaataatgcacattcatgtttatattaactaaatcttgattagaatcacttacccttttccaaaagttttgagaaaatatatcttttggggaagactgaacactaaataatctcaattacttcaccaacccaacaaaactagaatccgataccaatttactaaagagtacaatggttataaatcaataagaacattgaaaaaacagttcatgaaaagtatccattattcagtgtcagtgtagttcacttagttgaacaaatattgtttttactctacttttattctttttttttagttttggcaaactattctacatttatttggtcttttctttttccagtgtactaaaacaagtttccattgtttttatctgattggtgtgcaagaagatgaacccactctatttgtttattctaactttaaacacagactcttggtttctagaatataactcaccatgaaaactatagaaacaaatgtcctattttaatatgattttaacttataacaattagtattgacgtggatacattaattatatagtagggccgatgctaacgttcatgaatagagaatcccagtataatggtgaaactataatcatgacgtccacaaagaaagattgcaacttgtagtggtcggggaaccttaaacctcaactttaccttaaccattggaggaaaaattctataatgaactttaactttaatgtatttgctgctttcttgacttatattgctaacatcatttcaagtagagggatcaattcattaacatgtacagctttttaatcagtggatctctctaagtaaatatcttcctccatttcatggatttttttacatgtcatattcaccttgattacagtcactttcgaatattacttataacggaaataatatgttttttttttgctttacacatctctggttgaatacgcaattcgtaatttcctatgtgacacctgaaatcttgtatctttcttaaaagttatagactagcttcttgtggatctaacaaatccttttagctaaaaataatccattaaacctagttccaaatgattcaacattttggtatactaaattactaagtgtatgtcctagggatgttgtgaacaaaaaccagtctgatttaaacatactcttggtgatatatatatatagtcataattttcttaatcaagtacaaattggttcatgattttttgatccaccaaaacatttctaatgaaacgaaatactcattaaagaacaacactcacactaatgattgaacattaatatgaaccatgtgatattgaagtgaaagcactaactttaatgcttaacaagtcatcccaaaatattagagaccatgcatatttgtaccagtgagagttcagattaatcttgaaccttgtgtgtataactcagtaaaaactgtccacgtggtagatcaataaacaaccacaatctggcacacatgatataaagacaaagatttttgatatgtctccaattaatgtaaaatcttaacaataaaaaacaattctatagtatggatggtaagagatttgttgaaggagaagaggacgtgggaaaaatacaaagaagctaaaaaaaaactcattgcaaccacaaacaaaatggtataaagagacaaaagagagtaatggacatggggaattacaaagaagcagaaaaccttgcaaccacatgaaataaacaaatgtctttgtcataagataatgaaatcacactgttgtctcaatgtttgtttagatctatctgatcatatatcgctgaaacaaccacacaaaaagcaaagccacattttatataaagacccatcatatatcaatcaatccccatctctcttcacatgcccatttgaatcgtatctcctctcatttcttcttttgttttgttggagttagataaaatcaaaggtctaataaaagtgtcaaaacccttatcgctataacctccactaccatcttaaacttctccttataactcacgcttctctgctttcttctctcagagtctaactgctcaaataagaaa

SEQ ID NO: 641 - DNA, 3000 bp, Arabidopsis thaliana
aaaagaaggagaggaaatggggataaatgagacactcctatatgtgattcttcttgcttctccgattctaatggtcttcattgtagctgcacagagagggtatacacactgaagacacaaattcttgtcaatttcttacatgtaagtgttgtatatattatgaattaattcattttattacagttaaggattaataacacaaagcttcttttattaattgaaagaacataacagaatcagagaatcaaacaccaaagagaataaataaacaaagctagttgatcctagtttcttctacctttggatgagtctgatacttcatctctatagatactaaaacataaaacaaaccccactaggaaatgattgaataaagaaattgaaatccatctttaaaacttggaatccccaagttgactcaaaagtcttaaccacactttacacatttcattccgtgtagcaaatagtaacggcttgtgcaatgctaaaccctgaggagtcataagatttgatcatccatggccacaccacatgtcacaaatcttgactacttcttggtctgaccctgaccagctgccgagccacctttacctcctcccgcagaaccagcagctccaccagcattaaccattgtaactttaaacctttcatgtcttagatctgatggacccaaattaacccctttcgaagtgaaacgtggcgaaccagcactgagactcctccgcatagtcattgactttgtaggaggacgagaatcttgtttaatttgggacacagcgtctccgattttgttgaagaaaccaagaaactcgtctttagctgcacctggaaacatctttttaagcagctgaagttgtcccacgtaaagctctctcatatactctaataccatcagtactctcatgtccatccttgatccctcatcctcatcaccatcaccatcaccatcatattcaacatcatcattttgttcgtcataaactctgtggtagctatctcccatgtcgctgtactgtctcttcatactcccacttctcaaccttttagattcagggtcgtcaaacaatccaaagaagagactgttcttgcaattgttgtcttcgtcctttgtggattggtgattctgagaattgatgttaagatgtttcttccccatagacataattttcacaatcacaacagcaagaaagaagttggccaaatcttttgagcagggtatcttttgtttcttttgttttgtattgtttagagtatgtttcaagatctgaagaaggaagcaaaaatatgtttagatataaaaagaaatgaagatttggaagcaaaataatggggagaaagataagattttttgcttgttcccgacttgtcaacacgacgttgtcacgacttcttcaacgaagactagatgggtccaaagcatttgatttttatttgtttccggccaatcatgaagcgacagtgtatgtaattgtcaccattttgagtagtttcttgggagaagctgcaacttcggagataagtgcatacattacacatttttcataacgtgtagaagaagtaaagattgcatgtaaattacattagtatattcataacggcggagacttatctgcttctgatagctcaagttctggaagataaagtttacacggataactaacttgtatttcgaaactctataattattatgtaatcaaattcataaagttgcatgtatttttataattttggatttgtgacaacattattaaacacttaaacgaacgatcatatagtattcaagaaattcacattcaattaaaactctactgaagaacattaaacctgataaaacaaaataggtttattgaaagtactctacaccccaaatatggtgataatgttcgtattataaccttttgtttcagtttcactttcaattaaaagcattatacattcatttattagaaaactagtgtaaccattgtatttaatcaatatcggtctggtatacacctgagctggttatctgcgatttaagaggaattggtgaagaagacttgaagtagaggagagggcttcaattcaaaggagagcaaagtaaaaaaaaaaaaaaaaaaactttgaacaagtcagagggtttgttgttacatctgataacagataaacagtgtataaatactctgttcttcacttatacttcttctatgttgtatccaagagttcattgagcctaatctctctcgattcttgcttgctgttcatgaaatttgagatgtaacaaaccttctctgatagtggatttttgaacagaatttgatctaggcttaatggcttatgatccaatcaaactagctagtatgttcttttcgaatatgtttcatcagtctttcttgtgcgatttcgttctataaatcaattgcgatttattctgtctttgagagattatgagtttgcaacgaaactaagatatgtttagtccatggttgaatctaacacaatcaaataatctctatagaaagcaatatatgtgtgagaaaagaaatgtcatattatatttgtcttgacacacctttgtggactaaaccaaaactttaaaaaaaaaaaagtagtactttgtcggttcacaataacaaaaaaaattgagattcgtcgttgttaatttatgggataagaaaggagcctaaaaaaaaaagattgagagagaaaagacaaaagatcataatttcgtgtaacacgaagaagcaataattaatcatcccttaaaaaatggccacaataataaaagagaagtagacccacccaccacaatatcagtagtgcttgtccaaatcacaaaagttattcaaatctttcatttgttttaagtttgaaccaaattcacgtaaagtttacaaaaggcaccgagacaaaaccgcacacgcatctttttaccctaccaccactattgaaatcttcccattttcttctgctctaaacaaacaatagcttggtcttgaggcaaagcaaaaaaaaggaaag

SEQ ID NO: 642 - DNA, 3000 bp, Arabidopsis thaliana
ggcggcagtggtgtggatcttgttttgagttgtgtcgataactatgaagcaaggatggctgtcaaccaggtagctgttacttctttctcgaaaaggcttttttgttacaaattccacagttcttacttcaccatcgagcatttttgatcttacattctacataattcaattagttgggaatggaaaatatataaaatattctagattggctctgatttgagtttattcttatgaaatataggcatgcaatgagttacgtcaaacatggatggagtcaggtaaatagtatgctaataattatatgtacttctttttttcatttctcttttggctaacaaaaaaggtgatattttgtgcaggtgtatccgaagatgctgtttcaggtcacatacagctcttggttcccggagaaactgcttgttttgcttgtgcacctcccctggtatgtttttttccttcttatatcactcttacaactctaacctataatgccctgcattaattagtgcttgaggaatgtatcagtggaatatgggtggttttaaggattctgtgatccagggtattgttaatactactttttggattttctctaagcaatctctttactctgtggtaggtcgtggcatctggaattgatgaacggacacttaaacgggaaggggtctgtgctgcatctctgccaactactatggtaaatttcataccaccttacaatacagttcaaaatttggctatgttgactatttatcaagttttctgctattgcttttgtttatttaagcgctatctatatattttaagactcttgtttgattgtcaattcagggtgttgttgcggggcttttggttcaaaactctctcaagttcttactaaattttggtgaagtttctccatacttggtataggctttgcttcctccagctctcctcacagttaacactttatagtttatcacagaatgattataatttgaatcagttaaagcttactagttttatgcccgttacttgatcccacagggttataattcactgaaggattttttcccaaccatgaaaatgagaccaaatccacaatgctcgaatgtagcttgtctagagcggcaggtaacctgattaaatgcaaccacaaaactatctcagcttgtctttgttttgcgccttttgtttccatccatgttctggtgaaaaagttgaaatcccaaaatgcagaaagaatatatgcttgcaaaaccagaaagggatgctgctgctaaagctaagatggaagctgatgcatccacaactatcgatgaaggtccactccatgatgataatgagtggaacataaggtaataactcagtgaattagttaaaaatcaaaatttgtatttttgttatcatattttctcctttccagccatatttgcaacaagaaatctgatgtgtatctcatgtctttttatcagtgttgtcgatgatgaaaatgagaaggatactacaaaagctgcctcaagttcaggttacttaaacttgggactctatgtgctatccatgtgaaaatgtatcaaatataagtcctgttcttctgactgttatctaaattgatcctgtgttatgtgtagatacattacccgaagggcttactcgggagcttccagttgcagatgagtatgagaaagcaatagccatagcctcagggtcaggagaaacagaggaggaagatgaccttgaagatctgaagaaacagctcgaagctctcaacgctgcttgagtctttatgagggagaaaaaatagttgttttagcatatttatacatgaaagaggctacaagtgcaattgtgtatgcaaaaagagtgtgttaggattggtaaattggatctcatggacatataaacgtttttgatgatgacttctcccgtttttttagttgttaccaaagacaaaaagatacaattttgaagatgtttcatggatttattgtcataatcatccgaactagaacttagaaattcaaattagaaaaagattttgtccaatgatgatgatccaagtttggtttgtaatgtgtaaaccagcttttttggaggtaagatattaattgcgcggggaaatcaactagatgacgtgtgaatcgcgaattacaattacgtttttggatggagaactgtcttttttttcctttttatatccctaaaatacttttttgtacattcatttatatcaggaaaaacagagttgtaaccaaattattacagagatattcaaagatatttcaacctatcaactaaagatgacgtgtatattgagaatggcaattgcgtttatgagtgggaaaccaaattatttcattaacatgatctttaggaataccgctaataagagattactaatcactatttgaggttttaatttaaatctttgtagtcctgattttgaatatttcgttttagctaaatcagctccaatttttcccagttatcgtttgtcgaattcatattactgttaatttagttaacttccgaagactattagtacatgattcttcaacaaagcaaataaagaaaagaatcttgatgtcgttctctcaacaattcaacaaaacttggtctcgacgactcgaccgtgtgagatgtttgagaagtcagaacaccacacgtgtcgacataaagcccgcaccacgcacgcttttcgtctggatatatccaaattactttacagaaatcatttgtattgtttgttaataaaaactttgaaccactttgattactatattatttttttggaatttattctggtgacattaatgttctatcctccacgcggttctcataaaccgacttggcttctttatttttcctttatctttctctatatatttacacacacacgcatttgtgcagagatattcaaagattagaaacattcttgatagatacaaaaaacatttttcagacacaaaatcataaaatctttgcctttagtagatcaaagttctttacattaatcgttagaag

SEQ ID NO: 643 - DNA, 3000 bp, Arabidopsis thaliana
aaaaccaaggaggaaagcgctaccatgttcggtgacgaaccattattctagactctgcctttaaatttcttatacacaagaaaagaaaatcttttttttgtcttagctcatccgatccctttcggttacttgattcaattgtaggattttcgttctataaaaaaatatattaccgttttggtaatatgtagcctattgtatatatatatatatatctataaaaaaaatttgtgttactatctaaattcaaatctggtagaaaaagtatatatacatatatatatatagttattgtgttaatactattttcatataagtatatttcttagtttttgttaaaatttatgaaaagtttttttcgtgatcaaaagtggcttagagtaaatcacattttaacaatgaaaacatcaattaatcatttaaattaagagtgtccattgaatacgtttccaatagtaaaaatacctgatcattcacaaattatcagtggcggacaaataatctaaatatttagtttgaactttgatgtaagaggtctttatcaaagaaaaaactttaatgtacgtctgttataaaacaatgggaattcaaattggaaaaatattatccctaaaagttttgatgaatatatataagttacttttagaatatggatatggtaggatgtgatcatcgcatgatgtactgggagctgcaaaacgccatccaaaccagcactcatgggcatggccgcccacgtgccacgccgttcttcaactctgacgactctgaaacttctcaaaatcatggaactacacaaagttggtgtgataagggcattttagtcaacacaacgagttctcatcttggcccacacacattacctcagaagttttggaaaacataagaagggtagttacgtaagtttagaggtcattatggagggaaatggcatattcgcatataccgaaggattatacttaacgtgcagtggatattctatcaacttgtccgggcccatattggggcccatttggtgccacgttttttgtacggaaccgcccgacgtggtaataattgtggatgttgttctttaacaggatcgatcctttgatgacgaggcgaccaattgtcttgaattgattctagccttgggttcgaaccgacgtggtgttatttgattattatatttggtttcagtgtcatacactctacacgagcctccatttcaaatttaataacaaatctttgttaggtcatattgtctagctaatataacaatgcgactagcagaatgtatgtactacataatcagattttatatattcttgataatctcttacagattttttataacaactgattatatgtaatatatgagtttagtgtcaaagaaaattatgataatatttttagaatcttgaaaaattaataacaagttatttacgtatggctgtggctgcttcattagtcattacgttagtcttttgaaattttcatgaccacaagaaaatatttcttccggttttgagatttttcgtaacaaacaaaattgaataatcgatgtacatcactaacttctacgtggcttgtgaccaagacaaatgactgtataaagaaaagaagtcgtcgttagggggaactcattttttatatttctagggctgatatttgatttgacaaaaaatattgtccaattatatgaaaaagtattacttaacaattcttctaaccattataatgaaaacatttctagggctgatattttagttttttgtaagaaaatcatgaaatgcattttgttttgtttgttttattacatgggccaagatatgaactctcaatttccaaatacagagacagctgaagatcaaaggataaggagtattttctttttctgtatacgtttcttggtttcatatgaacaaaattgattatgagaaaaagaaacaaccattagaaatatttattttatctagctatcttcaattattttgcctaacttgatgtgtcctttaggctttaaaaaaaaaacttgatgtgtccttttaagtgacacatcaatgaaccatatgtatagtctcttgttgttttataaagatcgattgaatttgattttcctctctatctatacgtttttgtttgtttaaaaatgtcaaaaatttgggtatccaggatgttcgaacgcaggacacgtatgaagtgacgtctttcaccgccgtaaatctttggattgacagtccggtaaaaacagattaatagcttgatagtccaaaacgcacgtataaaagtttttgcatgttgaaaatattcgtatccacacaacattagagatcaatcatgaaaccgatatattgaaggtcacccgacgtcaaatttcccctgaaagggacacctcaaaattacgtggttcgtgtaatcttttttcctttaagatagggatcggattatgcagtataaaattaagcaaatcgtatttggtgatatatcggttctaatgcataacatcttttatattcacacaatgaaatagctatttgttttcagtttcgagctaaagcccaagctccagcccaaatcaaacccatttgtacaaagaacctcactcatctatttgtgcacaaattctcggatttctccaacgctctcaatcattttataaaaattagaattatcttcaatctcgatatacgaacctaaataattgaaaacattttttttctttttatgtatttttcttttttatcaaatttctttttatgtatataaaatatttgtgaaagtttcttccacacatataaaagattaaatttctttttttatcccaagcttgaatatcaaaacatgagacaacaagagcaagtattagccaccacaaagcaatcatcttaaaactcaaaccccaaaacaaacaaaagacaaaacccgattgtttcgagcacaaacgtcacttgtggtttacatcgtcttcatcatctccataacttcatatctcctctccttccgctgccaccgttagcg

SEQ ID NO: 644 - DNA, 3000 bp, Arabidopsis thaliana
aatgtagcgaaagtcgctcctgaaagcgctataaagtttgctgcttatgaaatgctgaaaccaataattgggggagcggatggtgacattggtacaagcgggaggcttttggctggtggattggctggtgcagtggctcaaacagctatttatcctatggatctcgtgaagactcggttacagacttttgtgagtgaagttgggacaccaaagctgtggaaactcacaaaggatatttggattcaagaaggaccccgagctttttacaggggtctttgtccttctctaattgggattatcccttacgcaggaattgaccttgctgcttacgaaactcttaaagacttatcaagggcacattttcttcatgacactgcgggttagttacttatcgtgccttgaaagttcttgatatttctcatgatactaaaccgtatatgatgtgcagagccaggtcctttgatacaactgggatgtggaatgacttctggagctcttggagcatcgtgtgtttacccattacaggtcataagaacaaggtaaaaactcacaatctttagctttttgagtttatctatttcttcgttttggtttgaaactgagtttagtcatttatcatcagaatgcaagctgatagctcaaaaacaagcatgggccaagagtttctgaaaacgctaagaggcgaaggtctaaaaggtttttacagaggaatcttccccaacttcttcaaagtcattccttccgcaagcatttcgtaccttgtctacgaagctatgaagaaaaatcttgcccttgattaaaaaaagcaagaaacctaatgttgtgttcacagagagatacagtgaaaactccttgatggtgacgacaaaaaaaaaacttgagctttccgttttcctttttttggattcggtaaaggtcattcgagtgtagaaaatgtaacttgatctgattgattcttgattcttctttagtagtttggtgagtccataaacactcatttcttaagaaaatagtttttatgctaaatcgttcgtttccctttaaaagagaaaactttagaggatctggtgaagctctttgatcaactgaatgataaattatagtagttgttcatatctcttgaagctgtgtagaacccttaaacatctgcatcagtttcatgcccaattcatcacttccggcagaatctctaatgatttcaaacaaaactctgttttcgccaatgtcctcttcgccatcacctctatttcaccgtctgcgtcggcgtcgaaggaggtcgtgagctacgcgacttcagttttcagattcatcacaaacccttcaacgttttgtttcaatacgatcattaggatttgtacgcttcatgagccgtcgtctctgtcttctaaacgtttcttcgtcgagatgcgacgtcgctctgttcctccagatttccacactttccctttcgtattcaaggcttgtgcagcaaagaagaatggtgatcttacattagtcaagactctgcattgtcaagctttgagattcggattgttatctgatttgttcactttgaacactctgattcgtgtttactcattgattgctccaatcgatagtgccttgcaactgttcgacgaaaatcctcaaagagatgttgttacctacaatgtgttgatcgacgggttagtgaaggcacgtgagattgttcgtgcaagagagttgtttgattcaatgcccttacgtgatttggtttcgtggaatagtctcatttctggttatgcgcagatgaatcattgcagagaagcaatcaaactcttcgacgagatggttgctttgggtctaaaacccgataatgtcgccattgtttcaactctttcagcttgtgcacaatcaggggattggcaaaaagggaaagctattcatgattacacgaaaaggaagagacttttcattgattccttcttagctactggattggtggatttctatgcaaaatgtggtttcatcgatacagcgatggagatcttcgaattatgttcagataaaactttattcacatggaatgcaatgatcactggtcttgcaatgcacggtaacggtgagctaacggttgattacttccgtaagatggttagttctggaatcaaaccagacggagtaaccttcataagtgttttagtgggttgcagccattctggtctagttgatgaagccaggaacctttttgaccaaatgagatctttgtatgatgttaatagagagatgaagcattacgggtgtatggcggatttgcttggaagagcaggattgatcgaagaagcagcggaaatgatcgagcaaatgcctaaagatggaggaaacagagagaaactcttagcatggagcggtttgttaggcggatgcagaatccacgggaacatagagatcgcggagaaagccgcaaatcgagtcaaggcgttgagtcccgaagatggaggagtgtataaagttatggtggaaatgtatgcaaacgcagagagatgggaggaagtagttaaggttagagaaataatagacagagacaagaaagtgaagaagaatgttggatttagtaaagttttgtcatagtttggatttaattaaaattaataaactatgattactaatgtaacaatcattaagagtaaggacttaaaaactttaatggcccaggcccaataactatgctcaactagctgttaaatgtgtacgtacgtatatagcaaaataacagtgcacgtagaagagctcgcttttgaatgacgtggcctgttatgattggttagcttcgcgtggcgagagatttgattggtggaaacaacaaaatgacacactcgaccgggtctacgggattgaatatataatttattcagagaaaccgaaaaatacatatcactctttctccttcacgagggatttttgttccgatctacttctccggcttatcaccgatttagatctaagcctgaggtttccttttgcattttagagattccgaga

SEQ ID NO: 645 - DNA, 3000 bp, Arabidopsis thaliana
tgctgtaagaatttatgcttaagcttgaaggaactgtggaacgacttgtcttgctagaaactcttgagctcaatgaagctaaaagagatcccaaataaaaatatctatgtcagattgatttctaacttaacaattctataaaaattgattactaacttaaagcatgatcataacttgatttcgaatttcaatcctcaacgttaaccaattcaacaatctaaaaccaaatttaagataactattgaagatttaacaatccaaacagtcaaatagtgagataatggagtaacatatagattcaaacaccaaatgtttccatatctaaccccaaaattactaagagaaatcagacataagcagaaattggtatttcgaaaggtttgattttgaagatgtcagacaaagaacaaaagcctaaaagtcgaatcttaaccatcttagagaataaggagaaattttcaaaaacagaaacttacgcagcaacgaaatttggataaaggaagaaactttagaggtatggagaaaattaaaagaaagttaccagaattagcatgaggactgtggctgctactatccactttagctgatgaatctaagcaattacccatttctcactcgataaaacaatcaacagattcaaaggaacaaagccaacgagctttttttttgtttactctgcggcgcaaaagctgattgtaataattataatcactaaattatccaactaaagaaaagaaaaagaagatttttgaaaccagaattagagaagaagaagaagaagaaggaaggaagaaggaacacagagaatcacagcacaaccatacatacaaaaagtcgtggtgttggtggtggggttttgagaaaattacgattctgccctttgtttgcttttgttcgccgtggtccgtggctttttctcttaaatgactatactacccttcctttcggcgaatatttttggtttaacgcgggtatcaaataaggggaatcagggatagtttggtaaaatactgtgttagtagatctggaccacctggcaacgtctttgcttgcgtaagcagatccacgtcagattttttcttcaaagcttttttacattcacctttaagcaaaagcaaaactcctaaaagatgcatcaaatctaaagattaatttttggtaaaagattccattaaatttttgtcatttttagataatgtaaaattttttattaattaattcgaattggagtacagatggtttagtactgtttaattatagaaagagattagttaacacgcttttggaatattttaatttcaagtgtatcaaaactttattcatattaaccaaaaaaaactttatttcatgcattgaccccaaaaagaattcctctatcattcacattatgtttgaccgacaaatccaagagctttttttggacactacacattgacacgtggaaatgatattcgaataatgatttttttttgcaaattactatttcctcagtttctttttaagtgatgtttaaggttattacacacagattaaaaaaatatataatttttctcttttctatacaaatattattaaatagaatgaatttaaccaataaaaataattgttcaaaaattattaaatatatttaatatttgcataaaaagttaaaaacatcacttaaaatgaaacaattttttttgaactaaaacatcatttaaaaataaagaaagagagtatcataaagcattgtttaccagaacaatcactaaaaatagattatcaaatgagtaaaatgtgttatttattcgtccattttatggaattgtaaaatttgttaacacaaatcatgattccactaaaagttgtcatagaagaaaggcaaaaaaaaaaaaaattataattgtaaacatgtaatatacggggtagtgttgaaatcatccattatgagttgatgaagttaaaatacatatcatggtcatcagtcatcactcatcacaatttaagtttacattttactttttcagtgagacaagttacggttgtgccgctcagattactaaaattgtactataacaattcttttgtcggcaattgaatagcattaaaagtttaatgtccgtattttgcaacttgatacatatatatctccaagtgatttatataaatatcctaaggttttaacacgaagcatgtgaatagtataaacacgacaaaaagaagcattcaatagtaatcttttgactatttcaaactcttcttatatatagatttgtcaaccatattatctatccatgccatcgatgcattatgatatttatggataaaaaagatcatggactaaaaaagtagtaaacgtagtttatagattatgtttgagtgcatattattttatttgctatcatatttatactttcaatcttttctttgtcaacaattctatctttgctttacactctttagtatcttatcatctttggtttaatattttatcaaaatccataaattgaacatacgagttttattcagtttgtcgctttgaagtttggatgattcaatcaaaacacttaagtagagattaaaactcttaaaactccatctaaatcaaagattaacgacccttaaatgatgtgactctactttttgtcaacttcaaagcacccaccgaaactttccatcattttgcaacttacaaagactagcgtgtggtttttacgattagaaaacggcgtgtagtttatatttataattcaaacacggaaaccatttcacgagctgcactccaaaagtacacgcgtcatcgttaaccaatcagaaacgtcaagtgagatcatcagtccagtgattagcttccacgtggaacatcgacgtatctattttcgcgcctttgtaacagcttcatcttcccaaatccaaaacaaacatttttagtttgcgattctcggattcgatcagtgaaattcgaatcgaagcgccgccggaagaatcatcgccggtgtgggagcgtttcccggagcggcg

SEQ ID NO: 646 - DNA, 3000 bp, Arabidopsis thaliana
taaaaaaatcacatatatgattcttcaacacacatatgacattgaggaaaaaaaaaaaaaaaaaaaacaacaacacacatatcacatatatcatacaacaatcgtcaaagctctataaatctttagatgacttttatattttatacaataaactctcaagatatagtatttgagtactgtaacaatagttgaatgttataaggtggctacatctaccgaacattgttttcaagatgattcgtgacagcttccaaactacggttagatgaatattcttctatacatttaaatggtcaaatactgtatgcaacattatatggttctaattggtaatatattaaactatcgttgagttgcagtcgatgtaataatttaatgtcagttgctatgtataaaaaaaaactatatggttaaaactacaggtttatgtgatgtatttaaaccctttctcaaaaaaataaattgtgatgactttgatgtaaaaaatatgatgtaacaatttatgataaatgattaatcagtcacttttttattttgttgaaaaaataacggggcgttaatccgatgttgtgtatggatcttccgattaatcggaaaattaaattaaaattgggaattagttggaattaattttaaggttattttaatgtttttaaaacatattaatttaatattattttcaaaaattatagtaaatacataaactgtatttaaaaacaaaatatatgatttttattaaaattttgaacttaaattattgtaaaatatcacaaactctaaaaataaatgactgaataacaaaaaaaaaattgtttcatacttacaataaaaaaatacttaggaatatgtaagattagacaaggattaaaaggatagaaatcaaattaaatggaaaataataaaataactgatttttaagcgattagtcattaatcaaagcggataagatggatctaacgattaagcgaggattaatcgggttaggtggagattcttagaacggagcttttttgctatataaatttcaatactatatatatatatatatatatatatatttttattctttttgtgataaaacagttttatggcaaaaacaaaccacacttaggttaagaattttacttccttaatttttcaaatatagatattaactcaatctataaaacataatattttcatgattttgagttaagaatgttacaaaagacaactccaaaattgtaaattcgtcataacacatatatactttaaactaaaattttcaattaaatcatttttttggtaaactaattcatgcaacaataaccgtattttatttataggaaacaaagaaaaaacccaaatggtgccggtcggcgaataaaatgtgagagacagagccaaccatagtccagctaatgtttcgttagtacctcacaaactcccccagtcacgagcttcacccaccttcttctaacactagtacttaaaacaaattaatgacaacgtctacgcgcgtgataatcacgtgtcaaaattcatgacgtggaagcgcgtagtgacacgtgccgacatagtgtcagtaaatgctctcaatttacctatggattaggaattgtaggattactctctcatcttcctctatctactaacttgtgccagctgtacactcttccccatattttccagcctgtccaaaaaagtcctcccaacgtctctcagaagtttcacattttttctttaactgcccacgcgctttacccacagaaggaaaaaaaaaaacagcttgcataagggtatttacgtcattagatctgtaactaagctgtatattcttcaacacatttttatcgatatggtcaattttgattcctctttttaatcgattttttattggctgtatgtaactattgcttaatctgacacaattaaatctttattaattgttttatagtttatataatacatatataaacactaattattcctttaatatttatttagattacctctagcaactcttttttattggtccaacttgatttcattttctaatttgtagtattaaataaaaacatccacaacatgtacagcttttacaacaagaatcctatgtctcattctagcctccatgagtagtcttatccaaatccaaatatattcaaaatatttgtatatatatttaaaaataaaattatacttagcattatataatactctttttgtttcatcaagattgatgttataggtttttttcttattccaaaaagtttgatgttttagatcaatatttttattacttttatttgtaactaatatgtagaaaagagaagagagaagtagtgttcgatattattaaacaaataaaaaataaaaaaaatattttttttaaatttgtgtgaaaaacctataacattaaacttcatggaacggatggaatatttatatgaaattatacgtagcattatacatatttttatgaaaacttttgatgaaagtcattaaagaaactgaagaatttataatgacattttcacattataatcataacattgaaaaataagaattttaaaccaaagttgtatgtaatgaataagttgtcggactcgaaactgagtaaattataatgacatttgactatatgaccataacataattaagaaaattcaaattttgacataaaccaaaagttgtgtagaactatggatcattcgttagctggcaacagtacaatggtccattactcctttgtatcttttctttcaatttctctgcaccttccctttctctttcactttaaagcattatttataacatacctctctctttttttccatctttattatttaaaattcatattcaaaatctaatttccatttttaataataataaatccactctgagagaggcatatatatagccccatcacactctcatatatctcacaaaccaatctaaacatcaaagacaaaaaccaaacctctttcactattacacttttcctcaaaaaaaagaaaa

SEQ ID NO: 647 - DNA, 3000 bp, Arabidopsis thaliana
gattttggaggctcacaaagaagatggagctaggcttcttgaattcaacgaggtaagttttgtgatctagttcataattccctgcacgcagagcttacttgacttgtatgaatatctgatgtaactgtttttttatgttgcaggtatctatggaagatcacatcaagagacgtaaccatgttgctaagatgcggagcatgctcttccgagttgacctgaaacataaacgaatcaagcagattaagtctaaaacatatcatcgccttaaaaacaaagacctgaatcaatcgggtgttggagcattcatggagccagcaatggctaaagaagaggctaagaagcaggaggcgaggcgagtaaaggtgagtctataatttcttcactgattttttcatcaagacagtgtaaacaaagtgataattgtcttatttgttcctatgttatgtgcttatatgtgcaggaacgtatgactttaaagcacaaaaacacaggacaatgggccaaacgcatgctaagccgtggactgaataggaaatacgatgtgactcaggcagctctatctaaacaacttcaaattcatgctactttgtccagaaagatgaactccacaaaagatgaaagtagtagtgatgaggaagatttgaatgatggttcagatcaggatacttctaaactgatagcggaagcaaaggagaagatactgaaaactgtggacgatgatgaagtccccatttctcgtcttatgtcattacctttcatggtaattcttgctttgttttctcaaaacacttttgaatgtttttattctggttttcttttcccgctcattcatgtttttggtttggttaggctcgtgctgtgaaaaagaaaaacgaggaagctaaagaagaaggtaaacgtgatattgaggagttggagaaatttggtggagcagaaacctctaaaaagtccactaatgttgttggtagaagagtatttggtgcagaagctccaaaagagtctgaaaaggaatcagacaacctttttgataacagtgatagtagtgacaatgatatggaagataatgagttagaggctgtaaaagataatgcttcacctgctagaaacactgaaaccattatggaagccgaggtacgttctccggttagtcattatggttctttcttctctccctttgaaaatctctgattaaaacatctgttgtttgatttcctgcagaagttggatgatattgctggaaacccagcatctaagacaacatttgatgtcgccttatatgcatcaggctcctggaagaaggttttgtgtggagaaaaatattaatcagaagacttgggtctctctttgttaactcttttttgtatgttatgcagatgacaggctgcaaaaacgcagaatccaaaaaagcttcaaagacgcatgtgcccatttcgcagtcccaagataaaaaggtttcttttcttcaaatcacaatggaatgatactactaatttcttccttaatttatccccgttccagttttagcctactcatgtgtttttctttgctcgctttgtgtatttactctttaaaatcatttaaggaatcgagtgattcagaaagtgatgattcagaaagtgatgattcagagagtgaagcagagcaaatggttgatgggattttgacatgcggttcaaaggaaacgtatgaaattccttgtcaagcagagcttgtaagccgtgcttttgctggtgatgacgttgaaggtgactttgagaaggataagcaagaggtactaaatcaggaagttcctgaacccgagaaaccggttcaagttgctggttggggacattggaccaataaccaaaacaagagaggtttaccatcaaggattgttagagaacacgaagaagccaagaaaacgagagagcaagctctcagaaaaaggaaagacgcttctttcaaacatgttatcatatcagaaaaagttgataaaaaggtcagttctgtctcacttaatatgctcatttataaccatccgatcgattctcatgctgacataatctatttttgacaggctgagaaacttcagacaaagagtctaccttacccttacacatcaaaggaagttttcgaacaaagtatgcgtatgcctataggacctgagtttaatcccacaactattgttggagttctaaaccgacctgaggtacccttttcattactttgttaaaactctcatcattagtagtatacccatttcgcaaaatgttgcattttcttaatcattttgtgtgcaggttgtgaagaaagctggagtgatcattaaacctgtcaagtttgaggaagtaaatccgaatgacgaacaccctcgtagccatcagaaacaaaaacccaagaaaaaaggtggtaagtaaaaccaatagaggtcagagcaaagtaaaggaccaatgattttgcattctcaaacttatttagacacaaaactttgatcccaacggtaccatttttctttgtattttttgtcttatttataaaagaaacatttaaaaaggttttatttcatagctcttcaaatccttgttcatcaccatttcttccactaagaaaaattgaaaactttttgtctccgggctttggtatgggccacttaggactgcactaagtattgagcctataaggcctttgtgtaactctgttaatattatccagctttaaaattgaacactcgacaaagggtaattcagtaattataaggtttttcaaaacacttgtcgttttgtttacaatttacattttaagcaatgggagcaaactacataccgtttcttatctgttgcacgaaacggcatcgtttactaccaattatctttgcttcatttcctatccctttaaaacccttatcgtgttttttgtttcatgtaaaacccctctcgacattttgcgactcttcttctccttatcctctaaatctctcaccggtcaccgacgacgggaacttggtagttacaggaacaagaa

SEQ ID NO: 648 - DNA, 3000 bp, Arabidopsis thaliana
atgtacataagaaatcacaattacataagataccagtcgaaaaaacattaatattgtgtagcgtttcgaaaatatactctgtttgaaactttgaatataagcgggttttcactgtaagatgttaaatttagaaggatttttttttaaatctatcgtaatattaatgacagcaataaattgggttatcaaaaatgctaatggcgtttaaaagtttttaggtgttaatttggtaggagatgtatcagttgcgtgtcctacgtgtaattgtgaaagcaacaacgcaaagaaaatgaagccttgatgaaaatatatgtttaaaacaaaattaattgacggaaatagtatgttttaaattaatgttctaattgtacaatagaaaaagcatgtacatgtacaaaactcagttatattgtaatcaaatttattgatctgtaattcatgcttgtttatgacttttttgaccggccgatagagcggcggacgcaactttgggatctgaagatattaaaagaaaatgttcctaaagaattctaatatcgaagttgattctcatcgtttcttactttatttctttatgatctcaaaatcatcaccctttagaaaatttgtttcatgaccagaaaatatgcaagtgttaacatgttttaatttagactgttttcaaaatttacagttgttatttagtaaaatttagcaatgaatacaaacaaaacgatacaccaaattaatgtttgtagtatttactatttagtaaatgcatggtactgtggtagactcgctaagtaaattgcatgtgttacattttaatatgtaaccagtaacctcatgcatgtgtatctctttcaagtttcaacaacctttttgttttttagaagtaaaaacttaaaattctttaattggcggacagaaagataaggcgattactcaccagaccaacaaaattaaatggaaattaaatacatatagagtaattaaatggctctgtgaccaaaacatggaattaatgggcgttattcattagaccagtaaaattgactggaaattaaatatatatagtaatgatacgatggtcctgcgacgaaggaggagccatgtctacgcaactcatccaataagcaacacaagctattcttttttacttctttcatgattgtcagtttcttctttcatttattctatcattgcttgagatatgtattctttaatagaagttaaatagtgtgtacatataccatgttgtcactttttaacaaacaaaaagtcatatggtatcatcatcatgtcgcatgaagaggagctacaacatttcttgattcatgcgttacgtggtctaacaaagggaatgtgatgaattgtcgctctgggagtaatttcgaaacgaaagttttcttacctaaaactctttattaattatctgagtttctgtagagagaaatagcatcaatttaaagcttgaaaagtttaacacatctttgacaaaacaaatttaggaagaccaaaaccaaaataattactatttctctctatctgttttcagtggggggacgaaagacctttctttctttttggtaatgggccgggccgggccggtttaatccaaggcaaatggcaagatccgtagagttttacatacaaactttactctagtgtaaacaagaaagtcagaaaccgcatgcgttatagttagtgaaaggttcgatttctgtcaggtcttcgcatccgtcacgtttgctatctcgaacttcagggagcatattacaaacgtaaaagaaattgatatattacgctaattaatttattcccgttgttgtcaagaaactaatgtcttaattagccttttaggttaaaccctaatttttgtcgatttaagttttgaaaaacgaattttgattgtttggattttggtaaaaggagatcagagttcatcgctggtaccatgttggttaactggctcgccgggagacccagcaataagttttatgctctccaaaagtcaatagacgagctacacaaggtattatcatatatattggcaattgatgtttttaagttcctatttatttttctgtgacattgaatctattttcaaaagcacccaataatgtggttctcattctttttttctgatcactaatgtgtgttcacctcaagacgctcgagtctcttgaacaaaaagaaaaggtttctctgctgccgtacagtacaaggaagcgaaaacatgttacctggcaggttacaaaacatgttacctggcaggttacaaaacaagtatgaaacatcttttgattttgaagcacgaaaaagtaaaatatcttattatcttttatggatcaatttaaaacatgtgtgttgaatcttgtcatgcaggtgctaaactttgtttgaaagagaagaggattcacgagcgaacagctcaatataataggaattgtcagcttctcttacatgaagctgtgagttttttctttttctttttgtgtcttactaaattatttttttattaactactttttaagcgatgaattgaatttattgtcactatttttctttcttcttaattatacagctgattttgtgtgaaagtagaaaagaacaaatgattgaagctatgcgggatggagattttactacgcagaagacaatgcaagtttttatttatctttgtttgttccttttaatcttaacttatttgtatcaatctaactcatgtattatcctacgtctatctagactgatcggacggacataatgtgtatccatatttcttggctacgcgtgtccaccttttagagactatgcctttaggtagtagatgttttactacaaaataaacatatttagtcaaataaaataaaatttgagagaatcttctacataagtagctcacagacccaaccaaaggaccattgaataccatatatatatagatacacagacatataaacacacaaatattcgtgtttttttcaaactgtgagagaaaaagaaagagagaaagag

SEQ ID NO: 649 - DNA, 3000 bp, Arabidopsis thaliana
cactaatagatattacagtttttgaacgataaacaaaaaaggtctaaatctcaaacagatttgtaagtcttaaccgccacaatcattcgaagtttaagtatgatttatcagagaatcttgagattgttgttttagaaccaccactattttatacatttagaaaaaaggtatgtttgggtttttattaaccaaatcaacaatccctatttgttaaactaaatttgtcattcatattctaatcttcaatctgtttttctttcataaaaaaagttcgctgatgtaaatcattgcaatattagaatttatgatgttctttcaaaaagttggtcatgtaggaaatgtctaagactgtaaggcagtaacatttttattttagttattgatttttctgatttctaaattatcttatgagttatgaaaacatatgtttttatttggaaaagggtttaaattttaaaagtataatactactatggtaaaatttagctttattccttaatttttactacgatttttttttctagaaaaaaagatgttttaaaatcttacaaaaaaaggcgtctactttttaactttaaaatagatacgaattgcaaatatgtcgattggacaagaacgaagcgacttgtaagatatcagttaaaagtctctctacaagtggaaatgggtaaccaaaacattttattttggctttgtcgaagctattaaagttttttttctgactctcgaagtaacgactaataacgtcaactggaaacagctagttcagtgcatgagagacgcgtgtcgacatgcaaattgcataaaccaatgtcccatttgcggttatatactctgaacacatgaccacttgctaacttcaacaccgtcttttaaactcacgtgtttaattctatgaagcacatgttttttttctttgttttttcttcttcgtgaaggtaccttaagcagaaatcaaaacaagtttaccaaatagttttgttatgatacaccgataattattttgcaattacaagtaaaaacaaaaaaaggttttgatgcatggttcaaactaaattgttcgattctttaggttttgaaggtttattatgttttaggttaaggttcgaatctactttacactaaaagtatgattgaacattataaatattataaatgtaattaatatcgataaaaaatattggccattagtttggtgtagtttggcattttgtttgaatagtaactagattaaaaaattggcatgaatagcttggttggtgaacgtaaccgttcggaaatgagttagcaaaatacacgaataactttgggaaacgtgttaacgaacacaactccaactgtctatgtagacgttacaattttaaaacattaatatatttttttcaatttatggaaattttaattcgagttatagcatagaaatgtcagtaatacaaacaattttcttataatttgttatttatttaaaatattacttaaaaataaaatatttctctcgtgtaaaaaaaacaaacaaagatttcttactatcttataattttattcagttcatattttcttataattctttgccgatccctcaaaagtatattttaattttatgtttatatttgataaaatttcattacagatccctcaaaataaatttttgttacgccgcgtccacaaaagaatgtttttggggtatttttatcatgttacttagtaggttatttctaataacataaataaagtcaatactttttatgtcactcatatcagatgttttgcaaaacatttatgtatttaatttttttgatcatttgtatatgcagtattctatgatttgttgagttgattaaattaaaatattaaattatcattttgaaacaaaaattcttaaatatgcgtttttagcaaaacataacttagaaaatggaagataggaagtatattaatggcatttgaagtaaaatcttacaaattaaatgttactactatttttctattttgttggtcacttaaatgttataatatttacagcatattcaaccagcaatttaccaaaacaacaaaattgattctaattcaaatacaaaatctggtaatagtagtttaaaggtatactgtatttgatatgttattttaaaaaaatatattcataatcttgataatcgactaaatagtaaaacgttttggcatgtcccaataaaaaaataaggatacatttcaaaaatgaatgtgtattaaattaccacaaatatttagtagtactattagattaggtaaatgattttagacttctagtacaataacaatgagtactagtactattttctaaaataatatgtctttttggaaagtagcaccttattttactcatcataacatgttttagaaaacataacatgttatttaaaaatcatcacctcaatttaatgttgtttttaaaaatcatcacctcattttaatgttgattttttcttttaaaatttatacatttacttaatcaactatcacaatattatagtcatgtatctgaattacccaacaaaataatgcaagacatctataatcataattgacaaagtcttatttcgtatgtacgaaaatcaaataaagaatctttttgtcgatataattaaggtacttcatgtcgacaacataaatatataaacaaagttgaaattgttggctgaaaatgaggaatctaaagatcaaaataatgcaaaactgttttttaactttatcaaaaaaccttcaaatttttttgtcacatgaattgttttcaaaacatttcttgttaatttctgcgctcttcactttctggtcttgaaaatatgttttaactaaatattagagaacacatgtctctgtccagaataaatgagattaagaaaaaaaaaaaaaaaaagaatctctatttaattgactcaaaagttttctcataacacaaactcatctctttcctctcaccttcctcatacatcatctctctttctctttgtctcctcatcaaca

SEQ ID NO: 650 - DNA, 3000 bp, Arabidopsis thaliana
tttttgcatttgtttctagatatttctaaactgttgggaaataaaaaaatttgcacacaaaacatagttaaattcacgtggtatttatagagatttacttcaaccaaatttggattttgggtcattgttttatggacggataaactatccattagtcaaatttccacaaaaataatatgtgaattagattcgacaaggctaattcccccacaacatacgatactagaacaaacgtacttgactacttgacgtaacaatgtttctcttactgtcttgaaaataacatataactcgttcatcaccaattttcttgtacatgattgattaagtgtgtaagcatctttttcgattaatgatgatgatgttaattggagaaacaaatttttcataaattcccttatagacaaagtcttataattttgttaaattccgcatatattttaccaaaactttgtcgaatggaaagacacgtcaaatgtgctaattagaaactgttgtattgagatttcaagaggaatcaataataaggtactactagggttttatttcaattaggtttgaatcttgggtcattgtgacgaataaattatctacttgtcgattttctacaaaaagcacacatgaattagattcaacgtggccaattcatctaacatatgttactaaaacaagcgcaatagacgagttggcgtaattttattttatactatctataaagtaacgtatgattcgtctatcaccaattatcttgtaaatgatggtaaaatgtctaaattcgtttgtcgcttaataatgatgatgatatacgttactttaattaaaaaaagcgaattttcgatagatactctattaactaagcatgcacatatcacgttgtgattgatttatgcctagtaaataaaatttatctccagcaagaataattgaaacttcataactaattttgaatgctaaaatgttaaattgatatatgggaaacaagttatgatactcaagaagtcaccaatatctagtattggaatcgctgtggtgtttgtttgtagatatttttctacatttagcaatgtattacattatgattgcaagaggaagcaatattaaggtattaataaggtttttacttttaccgggttagaattttgggtttgtttattggatgaagaaattatccacttgtcgatctttcataaaaagcacacgtgaattagtttcgacatagttatatagttctcctaatatacgttatttgaacaagaatacttgactagttgatgtaacgatgttttcttaacgtttcaaaagtaacgtacgattcttccataaccaaatgtcttgtatataatggtagaatatatattttgttttgtcgcctaatgattatgatgtgcgttactttaatttagaaagcggactatttaaaaactgctatattgaaaccgcaagagaaagcaatagtaaggtattaatatggttttacttcagccagatttaaaccaccaacaatactttaaaccattggtcgatctttcaccacaaaaaccacacgtgaattagattcggtgtggctagttccctaaacatacgttactagaacaagcgcacttgactagttggcgtgacgatgtctttcttactaatttaaaagtaacgtatgattcgtccattaccaattgtcatatacctaatataaaatataaattcgtttgtcgcttaataatgataacatgcgttactttatgttaaaaagccaattttcgatagattttctattaattgtaacgttataattcattatacataacaaaaaaaatcttcaacaataatatattgaaatttcataactaatggatgctaaaatgttagattaatagatagagaaaacttataatactcaaaacatttaacaccaaaatttccaatatctagtaatggaaatgtaatgtttgttagtatataaatttctgcatttagcaacacttatgcttaaaaacacatcattgatccgtagaataaaaagacacctcaagtgtactaagtaaccgttagaaactgcgtaaaaaagtttggtaccactttttcttttactttttttgttttgtcaagttacttatcaaaaacttggaaattaactttctctctttttttttaaactcgtgaataacaatgaaacattcgtatatttttatatcataaaagaaaacaatacggtattatatgaacaaaaaaaacttaaagataaaagaggtcaacaaaatgtccgaagtatgatgatgctaagtttgattagttatcttttttatgtcagagaacaattaaatttgttttattattatactaaaagaagaaaaacctaaactgcaaaaataataattacgacccgagtcttcgagtaggacccacctctgaatctgtgacagacgccggtttcgttctctctctctcctttttttcctctctttgcttttccaaaaaataaagttgtctttttttatttataataaaatgatttgttgtttcacagtgtgttgtttgttttggggtaaaaaagaaaatcataaggatgctttcaatatttgttttgttttggttgagtgattgctgaagccaacttaaaagagagagaagagaagagtgactctgtgtgtgtgtgcaagaaagtcttctctttcacacctttcgttttctcgaacctctcctttaaagatggtggaggaatcttgggtttgacaactcattaacactgaccctctttttagctctacaagcatccaaggaacccctcttacttttccctcttcttcattccctctctctctatatctcccaattccttctctttttttaaccttgatcttcttcttataagagactcagagctgttcttcaagatgggattgtgtaagcttgaaacttgactatctgggtctctcccattttctgttctcttttgtattctgagtgaaagttttgttttctgggggaaaaaattagggttcttag

SEQ ID NO: 651 - DNA, 3000 bp, Arabidopsis thaliana
ttcaagaatcaattttcactcgaataattaaagtaattagtttaaagattttactctatttctttccccaaattaatataaaattatgaaaattaatgggtttgtgtttttctttgtataggaaacgaaagatgagaagcaacgttcagtgttaacgaattcagcttcatcgagatcaaaaacatggaggccatcattgcagagcatctctgaagctacgagttgatgtttgggttttacgtgagggacaagaaacgtagtctctgtgtgtgaatcattcagaagatggaatctgaagaagaaagagatataaacattattgaataaactcttctcttatgttcctttctggttataatttacataggagatgaaaattttatagattaagatgtaaaaagaactatgcagagattaagaactaagtcccttttttgtcctgttaatgtatatatgtgctccatgtgaagaaatcaatcaaaaaatagattgtaaaaacatacgtttttgttggtgtttactggtttacacaaattcttggaataaagttcaaaaaactttagttaaatgagtccaaaaacatttgatttagatggttatgtgaggtataaatggttgtaagaattgcattgagttggattgatcattggtaggtacacatcctttcatgcatttatgggatggttttttaagaaaataaccaattttatttgagattattagttatttttcttcagagaagtagtagactttctcaaaatttatatttctttgaatggaaaatcaaattgaatttacattgtcttttttttttataactacttttttcatttttttagcaaatagtataacatagatgagctaagtaaaccaacaaggatgggcatttgcatcaaacccataccaaaccaaaaaattgaaccgatattatgaatcaagaatttaagatatccttgaaataaaaaatctgaaaatccaactgaagccagccaatgtttttagactctataaaaagatatctgattaataaattgttacttttaattttaatttttttttaatccagaaaacaaaaaatcaatggtcaaaacatacatagaaatctcaataccaatctcaatttattctgaaatattcttctgaaaccagaaaccaaagaaatccagaccaaaccgaaataactaaaccggaataaaccccctatccagtcatagaaacacttgattctaaagattgcgatagccgccgataggccaatcactcttttggccttatccgaaatctttttgtgggcagaaacgtttgtgtcttaggccaatctctgtgtctctctgtccagagagaaatggcagcatcatcagtactactctcgtgcttcaaatcccatcatcaaccaaaccttctccatggctgcaactactcatctaaccaaacactcctcagattcaacttttcaaccccaaaacctctcctgatctcctcacggagctgctcacgacgattcagagtcttgtcagagaccatcaccgtcaaattggaagaggaggagaaggatgatggtgcaagtgctgttcttgatcctcctgccgccgttaacactaagctctacttcggtaacttgccttacaatgttgacagtgcaactctggctcaaatcattcaagatttcgctaaccctgagctcgttgaggttctttacaacagagataccggacagagtcgtggattcgccttcgttaccatgagcaatgtcgaagattgcaacatcatcatcgataacctcgatggaactgtaagtctcttgcagccttattacaaaacacataaaaaaaaggaaaaaacacattttagttgatctttgttattggtctttctcaggagtatcttggtcgtgctttgaaagtgaactttgcagacaaaccaaagcctaacaaagaacctctgtatccagaaacagagcacaagctctttgttggtaacttatcatggactgttacttccgagtcattagctggagcgtttcgagaatgtggagatgtggttggggctagagttgtgtttgatggagatacaggaagatcacggggttatggctttgtatgttactcttccaaagcagaaatggaaaccgctcttgaatcgcttgacggatttgagctggagggtcgggcgattcgagtaaaccttgctcaagggaagaaattttgatatcatacaacaacattgtgtaatcatttagagttttatacattagagttatgtttatattgattgaactaattaactcaaaagatcaataaaactttttatgctagaaggtgttggtccaaattgttcacttgtgtgtctttgccagaaaatacaacattagaatcaatcaaaagcattagttttgttccttctctcgataacaattaacaattaacaagaaacctagtgacttctctttatacacatgtaagaaaaatcacacagagactcttcgttcattagtggtgtgcttcactgaaccaaaacactatagaactctaacttcacaagtgaagagaccgtaaagacccaccccagagaggaagagctaaacggtggcgacctcatccgttaagaaattctatagacactcagatcgcacggtcttagttgatcaaccagggttacagaggtacgagcctatgacagttcaggttaggtcgtgaccagtccaacttatcttcactttagacgatgtgagacaaagaaaagactaaagtcacttaacaaagcctatacgtcgtcgtttccttcctcaacgtactaattgctaatatgtcgtcgtttcttacatcagtgagctaatgaagagagagactgaaacagaggtttcttactttcttctctgtatctctcatattttgcttaaaccctaaaaccctttttggattaggttttctccaaatcttatccgccgtgataaaatctgattgctttttttcttcatgaaagtttgatttgtgaaactcg

SEQ ID NO: 652 - DNA, 3000 bp, Arabidopsis thaliana
ctcggtttcaactgaaatatggtttcggagaacctgtgataactttgccaaaaccattcactaaaccataaccaggttaatacttatctgagtcagaacaagaattccgaaggtttgaagagctgaccaaagaacaaaacggtcccggttttgtcttctcggataaggaaaataaatggatgatcagccacaaaatctatcttcttaggaggtggccccatatcaagagcacaaccgtcatcttctacatcagcagttgcagccgcagcttcagcaccttcttcatcgatctcgacacaagctttatggtacattgacactgaatgcagtactcccacttgattcaaaacgcttgtagcagaaaaaccgaattcgatcttaaactttggaattctaaattcctcaagttcaactttgtatctcggaatgtgactatccaagaatccaggtgtagatgctattttcttcaagagataatccaatccatctttcttgtcagggagatagaaatacattgagaatttgcggttggtatcatcacggcctcgtcggtaaggaccttgaaaccgttataagctcttactttttgtgtctcgtagctggtcatgaatggcacagagactgtagtgccattgaccatgtggaagtctctgtcttttgtatagtacttttcaaatggtctcttccaagctcccttgaaatacaatgcgtttgcgtaaatcttgttggttcggcttgtcacagattcacgaggaagaagatctttgatgagattattggtgtgatcttcaacccatgaattcacctccttacgcacttcttcagccttcaaacaaaaaaaacacatattggatgatttttgaaaacagtctcctaattcgaattatgatttgggaatcaacatacattacgaactattaggtttccaatttgactggttgagtatgttctttaagtcaaacagctattacacacttcatctagaaacaccaaataacgtttctgcaaaaccctaattatatttcttcgaaaccctagtttcttttttgctgttaaagtggaaaattacctttgatcggaaatctacgggaacgtaaacagccttgaagaagttctcgaagagagccttgtatttgggatcaatcggtagtgatttctcaatccagaggccattcaccgccctcatctttgggccgccactagcgctgctgtcggcgtagacgatggatgatagttctcggaagacggatttgagctcatcgattgaagaagatctgaggaaggagaggatttcaccggcgactaagccacctccggaaccagcggcgtgcatggtgatcgcagagtttattgacgccggcgagaagatgacgttagattccgactcagaagataagacgtgcctcccaaggatcatcgcgacgtcgttttgcttcttcatagcctttttcacattcatctttggtctctccaactagatagagaacttgcaaaagggtggaggattatgcatggtctatggagggacagttatatatagtgaacaaatccattaagaaatttttaattattattagggtttcttggaaaactagtcactttgcaatccaggtgtataaatcaaacacttaaaaatgactactttgcaaattgtaaatagtaatatgactactttcccaaatatgtttgaaaaaattaaaatgattacttttcacttatctcaaattatttttacaatggaatataaatagatttttctatactaaacctctgtaaattaatactcgataagttccacttcaaaaaacgaaccaaaggtcatatttcatccatgcatgttcgaacatgcaaagagaacttactaataatgtttggtcccaaattcaagtattctctggttctctttgcatggatgaaagaagatggccatatttttataggaatgttcagaaggagaattcacaatgtggagaagatagtgctactggtttatattgaagtcaggttaaggtttatgatagtttcaaggacattgatgcggactaattggcatcagatagtcgtgcttccaagactaatatcaggcgtaatgggttttactaatacgattatgaaacagcctcaagaaaaaaggcaaaaaaatcgtattggagcaaaaaagtcgaagaaatatcacgaatatgtgttttcgttagcgaataaggcgttttcgtccaaaacgcatcgtgaatcttatttttcgtatttttttcagaaaatggctcacatatctgcttgtgtaataattttggttctgtagtcttgtataactttaacactttaatttcgatataatggaatgattttaaaaggaaaaaaaaataataaaaaagaagtaaataaatcgatttttattaaattagaaaacaatttaattttggattgaaaaaaattaacgtactagttcaaaacgccaagttaatatctcggatagtcctactttctcatgattcagttctttatagaccatctaaatcaatccgtctatggatctaaaatcgttcttgaaactaacatgatgaaacggtccctagataggttggccgaggcaaagaagaagaagtcagctcttaactctaaaaaccaaaaggaaaaaaagaagtcagaccttactcgttttgtaaagatttagtcagcgaagaagtcgactagtgttcgagtggggaaacacgttgtcaactcttaagtctaaatctttgaccccaaaaaagagagcaagttgtccactataattctgtcttcttatgcaactttcatttttggccacctaaagtttcaagcaaaacaacaaaaatgatcttttagaataattattataataataacgacgattaatgaactctatatatctcacaaaagaaggacatgtttgcaatcccaaccaagaagataaacaccttagcaaattcaaagaagaatatatcaaacatcttttgtttctaagaaataagctctctgatt

SEQ ID NO: 653 - DNA, 3000 bp, Arabidopsis thaliana
cacatatctatgaatttacccacatggtaagcctgattgttttcttgtttgatctcttgtctgcagcggcggattaacctgccctgcatctgattttatcgaagagacatttcttctttcggttaagcaagctctccctcagcacggtcttttcatagtgaatttggtcacgagatcacagtccgtcaaagatatggtagtatcaagaatgaaaaaggtaaagcaaatgtgattcattccttgtaaattctctgcatattttcacaaatctgatctgatactattgcacggaaattgagtcatagaattgatctctattgttttgttttttgccaaggttttcgatcatttatttggcctgcaactagaagaggaagatgacgtaaacgtagtgctctttgggctttgctctgaatctgtaatcagcgagaacgatattccagaatctgcagttatactggagggattgctcaagtgccagagattggaaacgaagcaaagcatcatagacgctacaaagaagctgaaatgctggaaataaaaacattctttattatttcgttttaaaaagacgtgtgagatatatttctgttataagttaagattgaaatttttgagactatattatatacaatacacctagtttcgtccatacgcaaatggaaaatgaagcgtggagtttttttcataacctttatgattgttagacctaccaacttattgaagcattcaatttggatgatagtgaagttggaatgtaagttaaacatcaatgtcttgattaattttgtgcatttttgggaactatccgtattgtttctgatttgagtgatcttccttattgttgctaagaaatgctcgaatggtgattagcataattgctgtttattcattggagctataataattatggttgtaatattgtaatttgggaaagaaagcctttgatacaggccgattttggtacgtacgtaagagagatataaattgaaacacctaaaccaaaatctggtcgccgcgaagacaaaagaaaaacatttgtggcaaagaaacaaattcagaaaccgcgtgggtccgatatggaacgctgatcaattggacatttgtaaacatttcaaatattttgcatgtaatcaatattgttgttatattttttgccttttagttatagttaggtttgttttttctgtttgtttggttagattcaactatttgtttatgcttttcaattttgggttagtatttagctgtttactttggagaaacaaaagaagatagattctgttccatataaacaaaaagctgtgtcgttgaaacttgaaaatgtgaatatactcggatatcaaccaaagggtacgctgcattaaccaacctccctcgtagaaaatttcaaagaaaggataacaaaacaagaaaaagcacaaagttgaaaaagaagtgacagatgcagaagaattggtcaaaatcattttgacaaaactacataaaaaacaatcaaatgtcactttcaaaattattagcttatttattattttattatgaaaataatgaaagcgacttctatctgggactggtaaaaggacctctctcaccattggttgtacattagctgtcaaatttttacatttccattacattccctaactccaaatatatacactaaactaaattcttcaagttacttcctaattactactatagtaattatttcctaaccgtcaaatagtactgaataacacatataatatagtttcgattgattaagagatttgaattaaacagaataaagttttacgattatatattctaacaatttatttgtctcacaaaaaaatctatagatttaatgagaattaaatgaagaggacgaaaggaaaaacaaaatgaagaaaaagacatatgaaacgtagtcccctcttttctttgctttcttctctacataaaactaaaactcctctctttcacgaccctttaagtaacgacgccgttttcatccaaacacaaacctctggaatcgtgtcaccgttggagctccggcttcattaatggctttcttcaagacctgaagacaaaagaaagtaaaaatatatatacactagagagaccaagatcctcgtttatgggtttcatcgtgtcttgtgcttagggtgacataaatacccatttagagagcttagaccaagaagttttagagtttgtgaagttacttgttggttagtctgctgtttctggcaaatgctgagtctcttctctctgtaagttcttttttcttcatttactctgttttgttccccatttttggtctttttgacttaacttagagtattttaaggcaaaataaaatcatgaatcttttggtattttttgttctcatcttcttgtggggtttttctattgaagtttgcttagctttgaatcttgtctaatggagctaactcgatccaaaataaaaacacgtataatgattaactagttctgctcattagatgaactaaattaatgagttaattccgtagtttcatgcatcctacaatgtattgtctatgtatggaagcaaagtatgatatcatatttaaacatctatgattgtgctactaaactttaaataatactttaagctgatgtgatcttatatggataacctctgaccattatctactttctttgaccattgctcttgttttctaatccaaaagtcgtatcttccaatgcattagttggtccaaacctagatttgcatcccttaatttgtagtagttaacatctaattttgatgttaaaaccaagacaccactttgtttgtctggtctgagaatatctcaaggcgtatagttttgtccttatgacgcttgcaaaagcaagttgttgagttgtaatcttatgtttttttctgcaacttgccttggatgaagccatgagattatctttataaatggtagcaagtaaaccggtttcttatgtcgaaaaaccgatcatttttgttttgtttgatgacaagga

SEQ ID NO: 654 - DNA, 3000 bp, Arabidopsis thaliana
tgacacttattatgaaccaggcagtacctgttgttgatggaaatgtgataagagtgcttgctagattaaaagccatctcagctaatccaaaagaccgacttacggccaggaatttctggtgaaataacttttgtatttgctcgaatgtttcgctattgagactatactaaaagagaggataaagaaatcatttatctttgtcaggaaactagctgctcagctagtggatccttcacgccctggagatttcaaccaatctctgatggagcttggtgctacactatgcactgtatcaaagccaagttgctcttcttgtcctgtttccagccaatgtcgtgcattttcactttccgaggaaaacagaacgatttccgtgacagattatcctacaaaagtaatcaaggccaagccaaggcacgacttttgttgcgtttgtgttttggagatacataatctggagaggaaccaatcaggaggtagatttgttcttgtaaaaagacccgaacaaggtctgcttgctggtctttgggagttcccatctgttatattaaatgaggaagctgattcggcaacaaggaggaacgcaataaacgtctaccttaaggaagcatttcgttttcatgtagaactcaagaaagcatgcactatagtttcaagagaagaactcggagaattcgtccacatattcactcacattcgtcgaaaagtttatgtggagctattagttgtacaacttacaggtttgaccactatctatctctttctttctaggtctcttttttacatatagttagagaaactaacaagaagttacaggcggaaccgaagatctgttcaaaggtcaggcaaaggacactctaacatggaagtgtgtgagcagtgatgttctttctaccttgggactgacatcagctgttagaaaggtacctccttttcgtcttcaacatattaaaagactatccttggatgtgatggttgagaaggaacaaattttggagtgcaggtgtattcaatggttgaagcacacaagcaaggcttatctgtttctcatgtctcatcaaatagaacagccatatcgaggaaacgaaaattctcatgatctccttctcacacttttcttcatgttgcttagcttctatagttcttgtctagcattgggaatcaaatttggtgatcttggtttgaaattgaacagcttagtttctactgagaaaagtgacggtgatgtgtgatccctccagagtccaggggttgattatgtattttgggctaacaaatattaaaaaaatggattgttaaggcccaacttaagcccagaaataaattcagtcagtggattcatataatcgcgtggactctttcttccaaatgatttacataaagagtcaaaagtccttgaacttcacgtacgaagacttgtcaaaaggcataattaaaacggacaacgaaactattcacttattaagcttggccgccaagttataatgtcactttccaaaaaagagacgtgtacaaagaagattcagtgactttcttcaccatccccttatatatacattatctgacatgtatagtaagctcaaattaacttaagaactcacacttaagttttaaacctccaaggatgtctctcttcacgctcttcttcgcttgctttgttccaaaatctggttcaaggattaacacaaccgacagtaatttggaagtcttgtctttgaagaaacccaaaagaaaaaccgagtccataagaactcctactatcgtcgtctcttattttcccgtaggctccaacctttctcgtctataggaactaggaagtaggaaggataaaagtgaaattctgtagttatgatcacaaccaagaaaatatatgaggctgatactattgatccagtccaatcttgtttatctatgtaatagaccaatgaaagattctgcttgtggtcgacacttttttgtaatgatgattttgttttgggtaagtttatgtatatacagtggcacagagacagaataactatttattgatataaatattattttttagtcaaaactttcttacttaattgaaaatgaaataaaatatttagcagcaaattatatcttataaactcacatgcttactcatatcttgtaatcgttttatcatttgcttcgttttatgcagtgttaataacatttgcaacggcaaatcgtcttttgagtaaaacatgtattgattctaacgattatagtacaaacagaaaatatgtttactcaattgctatatcagggtcagttgcggagtggtttgtttaaaaaccactctaccactataaatatttgtaaaatgatgtcattaattttttttataattatgctttacaagctttagttttggaccggcctgactttaggccaagattcaaattaatagaaaacctcgcacttaagttttacaactccaaacatgtctctcttcacacccttcttggcttgctttgtccaaaaatctgattcacgggttaacacaaccgacgctaacttgaaaatcttgcctttcaagaaaccgaaaagcaaaaccaagtctccaagagctcccacgatcgtcgtctcttactttccaataggatccaacctttcccgtttatagaaatacgaagatgaaagttaaattttgtaggtatttaaattatacctaaaattggtaaaaataaaaatatactatactgttacagttaaattttggtcatgtctacgtatgtacctagagccgaataaaatattgaaccgggccttaatatttcctaaacactaatgtgtttctctcgtcgacacttactttcaaatgtgacccagactcaagctatgtagagcccacttacctgctgctgcgctggaaatatgcgagacagctttgttcatataatctattttatatatctttcattattataagactcctctccaaatgctaccacacaattcctctatcaaagccgcccaatcctccacccaaaa

SEQ ID NO: 655 - DNA, 3000 bp, Arabidopsis thaliana
tacgttacacatccgaccccgtgaagcgatgaatagcgttgttagttgagccgtttttttacatcgttcgttccaaaaatatgtaatattaacatacatagttataaaatttgacaccgtataaatcgaagtcctatatggtttaattttaattgcaaagaaagtctttttagacgagtttatggtgatttttgtaattacgattttagtcatcgtaagccattgaatactacctcttccgcatatttcgacaattagtttgaatatttacctttaccacttctattatgaaaacaataagataaatacattctcacgtatatatgcttatgatataatatattttagatccaattatgctttcgaagtcctcttggaattccaagaaatatgagcactcacaagatcagttctattaacatgtctaacaaattgtactgttttatttctacgtaaatttcaatcataagtttttggtgcatcacgaaaacaatatacaatactgttttccagttgtatatatctactatagattcgggtacatgccatccaataaaacttcgttgcagaattaaatggagattatgagttcatgagattaaactataggcttaagttcatattttccagttagtaaataaaattctgctagccaaacaaaaaaagttgttccctaccaaaaaaaacaaaaaaagttgttgaggagaggaaattgtaagctttgatgaagtagaaaaaagaagaactttgtcattccccccacgtgtaaagagacttgccatcgatccttcacaagcttctcgtcaccactcctttcttctttacacttaatttccatcttccttctgcttctacacgtccacatgcaattttgcaccgagaatcctaatttgtgtccttcattttaaaggtttaaaaagcatgtttataaaaacatggaactggatggtttgtgagatatgccatcaaattagacaaaagggtccattaagcctgtgaaaaaaaaagaaaaaaaaaactaagagacgatcataagagttaggtgtgacctgacaagattcttgtacacccgaacccgacttgtgaactgtgaagtcaacctctaattaacagttattttttattcctacaaatacggatccaacattattctcaattagttgaagtaatgtctgtctatttgcacattttcaaacccataatcaaacaaaagttacatatcctgacccgctgaccatattatacactcatctgtgtatatctcaaatctcacttgcaggtaattctctctagtacttttatgtagatatatagatattagtagaatgttagcaagaaaagatgtaaaacatatatatcaactatattagaacccgtcctttgtgcgagtttttgatttttatgataattttaagttaacaaaaactgaattaattttgctttatatattaagatgtgtgtgaagctcaatacacaatattaatctattcttatcaaaaaaatttatattcaaaatttacagcaattataaagaactaatagcattgtattatgacttatcattaagatggggtttgtgtccatgtccggagttgttaaaggtttgaaaacccagagttatgaatgtaaagaaacaagacagaatgcttgaaaacagagcatcaagtaaatgttttgtgtttatattattatgcagctaaaatggaaccggtgacggcattccaacttggccaatggatgtctagactcgctatattcttcaaggcagacgacacattcttccccaacctcgaaattgaattcctcgacggcaacaaaaatatatcttcgaacgttttgttgtgtctgatcagccaactccacatctttaggtaaactctaatatcctagagaataatagaaatctataatactagttacaatgtagaagaagagacaacctataacgaagctagatactatagccaacgtaaccaaaccaaacaacaaaagtatgttgtgatagaccagtttttctttccaaaatacggcccaattaaaagtttggttctaaaaacaatttgggccttagtttgtatagtttaaaatgtgtttcttagtgaggattggtttttcatgcccttttgtttgtgtgctcctttttttgtatattgaagatcatatcaaagcaaaagcaatacaatacttttcattcaaaaagttcctccttctgcttgttcatcaaatctctcaggtaattaaatatatggttgtaccacttttagttttgtggtattcggctctgatgttgaatacttcaaatatctagatttgcatctgatgcaattgaaaaccttttttttttttgcaattgaaaactcatatatatagtatggctagatatatgcaattgaaaactcatatatctagccatactatgaaataacaattgaagaacttctaagttgaaagaattctcactttgtatgttttgatgaatttgatcttacattccaatcgttccaaatatcgaaactcttaaagcgtattcaatcaaacgaatctcgtcctagatataccttggtcatttcaagaagaagagaaaaaagttatggtcaagaaactaaaagtctaaacccatattataattctagtgttgatatacgagaattatatattggtcacttgcccaattaaaaatatcgtgtatagaaaacagtcaagtcaacaactatagcaaggggcaaaaccgtaatttcacaacaagcaacttgctcggttttttcgttatcaccactcacatgaactctgcattaaaaactctatctctctcaaatcgaaaggcacagcccaacttttcgcaagtcgctgtaaagtttgatttgcttctttttatatacacacatacttctcctccatacactttcctcttcaatcctcagttttttttctaagccctaataccatctcaaagaagagatcaagatttgaaatcaagaagacaccattactcagatcaac

SEQ ID NO: 656 - DNA, 3000 bp, Arabidopsis thaliana
atgacgtttttactttccaccaataataatgtaaccaaacatcaataaattttgtgtaacttttacattgtgtctttattatttttgtttctaagcacactagataaaccatatatattggaaatttctacgtctgaaattgtcccaaaaaatatggaacacaaaaatatgtaatcgttacaaatgaaaataccacatatgttataatttaatatatactttttagctttcttctacatcattattttatgtttatgtttttttaagcttttggtgactttggtaaataaagcaattataatagaagactcttttcaagtaattgtttcagaattcaaacgttaatcaacgaaaaacaaaactcgtcgtcctatcgctcccacttcatcggcttgtcgatcttaattaaaatgcttcaatatctcactttacatattttttctttacttcgttagttggttggttaataattttgtttctttaagttaattgctagctattcgcaagtgcatgttcttgtatgattttacttttccttagtttttatgttttatgattagacacttgaaaacaataaagaaaatctatctcaatccgtcttagaaaagtttaatactaaatcttaagtttgtagcaattagtccgtgtgcaccttgaaaattagtttaaaaaaaacaaattaagcggaacacacggcagagtctgaggaacagatcaacccttaaggtttgtatttattaagttgatagtgttttgggataaatttatgcttagttaagcacaaatatatatcctcaccaaaaacaaaatcaccaaatttatatgattaagatttctcttacttctaactaataaagtgagtaatatatttatgtaatgtgtaattaataatgaatcaccaaactatttgttaactttttggtccctctacatttagctacccaaatatataaactcttaacgatatccaaacctcgcgcgtctagagaaaaagagggttagcaaagaaattaattatatgtacgaacatttttttaatccccaaaaacactatactatcgttgacatctcgtgatagcaagacaacgtactattaattaacaacacttcactatttaatcgacgacagcttcactcaattgtgggaagttagagctcaagctttcgaaatccctctctcaagctatgggctttgggtgctgatgaaatcgagccatgctcttttcccctcccagaaatcagtttcatctgtgaactgtgatatatggtttgttgcatgttgtggtcaaatttatagttataaaaattacctctcttccctattgtcaagcttgacaagaagaaagaaaacaaattaaagacgcttgcaatgttgatcacaatcaaaatttggcggcgtttggagaagcttgcaaagttgacttctgtatttataatggattgactctttgcagaagaacaaaattaagagcaatagtagtaaataatcatagtttagttttttatttgtaaaattaattttctaaaatataatgatttacttatcgtacatctttgttatggattttaatgtatattttttagtcacgttatttttattcagtgacccataatttatataatatttattttttcctaagaactatacatatataaactaccaaatgtgatccataagtcacggtaataaactctgcaaacacatttataagtgattacataataataatataacttatttgtataagtgatatgtaaatagtgttcttcagcatttgtttgttttagtcaatctaatataaatatcgccaaaaaagattgatttttggttttgaaaaagtttccctaattgttcatattattttatccgatcctaattactttgaaaagcaaattagtatcttgaacttctccttgacaatattgaaattcgaataagaccagtttactgccacagtgccattcgtactatatgatatttgagtttattgtgaatcgatttttgatgttgcacaataaaaaaaaaaatagtagtcaaaatttagtcagaaataattgccaaaaaagagtttaacattagactttaaaaatgatcatgtaatatgtatgtattagatactataatatatggtgttagtagtcaatttatcaatcaaattaatatactttttacgtattggaacaaccattaatattttgtgcgtattggaacaaccattaatattttgtgattatggaaataaataattagaaatttggcaatatatgtaaatatctaaattatattatttttttgtattttagttaattttatgactacaaaagtcaaagagttaaagagtcaaagagtgatgaatgagcaaagatgagatgcacatggaacaaaaagccaagagattagagctggaaaaaatatgaggctctttgttcattggtttaaataacggatcatattattagaacgcgcgaaaattggtactcgtaattgctttggttacacggtaaaactcgaaatgagttaaatgcttttttttttttttggtcggacgaaatgagtgttaaaatttaaaaagacctttattcttagatttcagatttgcgtagttcttctttgtttcaacttaagatttgccttctcgtgatcacaaaatgcaaaagatcttcgaattctgaaacaacacgtgatgacgtgaacccgaatatagataatgattctctccatgcgtgcttggactgattagtaaactacaaaatatgattgacattttcatttcataaaaatatcataaatcatagtcaacacggcgaaaccaaaccctattgaaaccaaaactccaagcttcaatctaaacgcaagatttacgcaaacatttttgtcaacacgttctcctactatgaagctaccaacttgataactctaacttcatcctcaaatccatcgttcataaatagtccaaatttcgcaaatgcaaaaccaaacaaaaaaatatgcaatcaaga

SEQ ID NO: 657 - DNA, 3000 bp, Arabidopsis thaliana
ttggtgatagtcttttgatggcaacatccatcccattttttagcttttcctccggtcaaaatcaatcagaaatatttttagtataatttaaggtgaaactttgagaaattgtggaattagtcattatgacaataccgtattaaaagtgaggactagatcattcctatattgttgaccaaaaaaaaaaagatcatttactatatttgaccaacatggataaactcctagattgaataagaccttaaaaatcatagattgagtaaaagtaaaacaaaagttttctagtatcagtcaacttctgatcttatttacgaggtcaattgttatatttgctttataccttgtacacggaaccaaagccaccttctcctaacttgtttccatcagagaagttatttgttgcaaccactatttcacttagtggaccctgacccggcccaattctccaaaccagaacaaagctgctgcaatggactggacctaaacgaataaggaaagatattgggtttgtgttaaagacatgtctttattttggatcattttcagcaattcattctgatacatgcatgattaaagataaaaccatgaatcatactggaccacgtgtgtccaccccacttgtcaacttggtccattatacgtgtatgcataatctatatcacactttgccgatagaaaagatttagacaacaataaatggagtgaaatatttcaatgttctctttaggttaaaaatgtgttctctatttcaatgttcatggtttaatttactgttttttacttgagcaaatttacataactttttgatcagtaaacttagaaatgtatgcttatcgtaaaactgaagatacgtccaaaataattcttggatcggtgaaagaatctgcacaaacaacaaaatgaactagccgttgctaaaatttaattacataattgagaggacagaggatttatttatattaaaaataactaaattcgttgggatgattaattcaactactccacacacaatgttagcaaaagttagctgttggtaattactttacacatgttcgaatagttggtacgtttattattacaactgcttagtgaattactctatgttaaatgattatttttcctaatttcctatatatcctattcaatatctctttcagaacatatttttttaaagtatatttactgactgaatttttttattatggaaaatattgaatcctatacaaatgtttcgtaaagctcaattcatgatctcgtcattgattatcaagtcttttatattttcttttgaacagagcctgaaatattataattttcatctgtcaacaacatcatattttaagaacaaagttttatatgtaaaagaagcagaacaaaacgtacaattttgtattttgtaagaaaaaacaaacgtcaaaataagaagaatctctttcgttttggctggcataaaccacgtggcatttctagagtagcccaccgttgcgttgcgcaataaatcttatctctttatcagatgcctttggtcaaacggtcagatatcaaatcttaatttaaaacttgtcgtaagaatcaaatattaacacaataatgtaactataaagttactactagtacttaattcacttatttaaacctaagctagcacgcgagcagcatgtgattattgcgtacataatgcacttccctaaccgacaaattactaaatcaaaatcttcttcttttttaatgcatcattatttcataacaataatttcaccacaatcaacgtaaatgtttgatcatcaatcagaaaatacgcgttagaatattttataagaaaaattatatggtttatgaaaggaaattttacagctcattttgataaataaagcatataagagaaaatatttcggtggaaaataaaaagtatataaaaaattgtcaaccatatgggagccattcttttctggctgtcatgcagtactattatcattatatccgttggctttgtttttcttttctttttcaagtgtcaacttagtatttattttgcttaaatataataaattaatggtcaccgacgataaaaagaagattaaaactctctaatgaaggataaggtatctataaatccagtggtttaattagtaatatattaaaaagaaaagtatgaagaatgttattcgaatatatgatactaaagtgataaatgattgtcttagcaaatttaaatcatactatttaggttatatgcgctttactatttcttttgattaattaactaactacttttttaaaattaagtaaatagcttcaagtagaagaatgtgagactacatttacattgatcataatcttagtgatttcatgcaaagactaaagctttgaatggttatagcagtccaaacgaacaaaaccgtctacgaaccggattgctttttatttattatttatgaactattgtccgtaataatgagaatccaaaaaaataaaagaaaatcactgcagcctaattgaagactgtcaattaagtctgcagccgtttgttgtccgctttaaaaatactatatactggacagctgacggattagcccacactaatcgcaacatcaattttaaacctaataaagttatatgtaattatacccttaaatttatttattatctttttttttttttgacacaaaatttatttattcttttttctcatatttaggcaaatttataggcgtattgtgcggctttatttctggtaaaataatagtcaaaaagtaataataataaataattaaggagcaacctaagaattttgtagccgttctcttatgtctatatcactctctggctctcttctctttcttctatagcttctagtttctcccacttctcacttcctttttcccgaatcttgataatgtaaattcacaacaaatctgtttaaaaacaaccaatcaaaacccaacattgcttctcaacaaaaaagcaaagcaaaagattttgcgagagaaaaaaaagaaa

SEQ ID NO: 658 - DNA, 3000 bp, Arabidopsis thaliana
tgccgcctggtgccaaaaagagaaaggctttgaagaagaagcagcaggagcaggaagccactggagtcgctaccaacaacaaaggcttcaatggtcatggtactgtctttgttactgtttttggttttcgcttagaatttgtagttgctggatcgatatggattttggtgattctagttgctgtttacaggattttatgtctcaaatgggtttctggtgttaggtaaagtttcttcttttggtattatacaaaacgaagtgaatgatgctttggtcctactttatagggaatttttggtgggtggggatgaatctgatggggtattgagatttagccaatctctgtttaattattgttccaaagtttgtgactttactctaatcacatcatgtctgagttgtctctgtgttgcttctggatacttgcaagttgcaacaagtgctggatgttttttcctatcttttttagtaatcctctttgaatctgaagagtaagtcttttattgccctggatctataagtttactgaatatctcaggacatgatgaacatggaagccaagatgagagagacagtgatggcaatttgagttcccctggatctcaaggaaatgaagaatttgggactagagatccatcacctcctccattatctagtttagggaaagacattgttaaagagaaagcagaagatgcagactttactgggggacaagtagcgaaaggtgaagacgttattgaagttggaagaggaagaacggatcacgaggagaatggtgtaaacaaacaactcaattcctgtcctgaaaattttactcaaacttctagagaggctgatagtacttcaagtttggaaatttcacctgctcttgattctgtcaagcctatgggttcttctgtctcaaaagttgtgatgtctgacaaaagtaagcaagttgagagttcgacggactcggattctctccaacagaagtctgatgaaaaggaagagatccttagtccaagatctgctgaggaaactaacaaagaaatcaagaatgtgaaagaatatgaagtgccagaatgttctaaagaaaaggtataatttccttctttttttcttgcatcctctacttgaggttatttttcagttttctgaatcttctggacatatgtgcagagtcttttgccttctggtccaccagtttttcgaacgtcgtggttgagttgctgcggtttgtttgatgtaatggcaggatctgaaagataaatacgggttagtaattcttttataaataagttcagtaaaactttttcacttgactctgagcatcctaacattctagtaagctaagtaagagggttcatgggcttgagcaagaatttcggatagtggatgggctcctaggtatagtactgcttagctcaagagtttcaatcagtttctctatcctcattcaaacccttctcagaagtaatttcctactatatcttggtcatgtttgttcttgctttcaagtgtttgaaattggtttgaaccaatgataaattccaagtcatataataacatcacctatttggctaccgttgaaacctagcactgtaggattctagtctctgaaactttgattcctttactcgaaagctacctccatgttgtttacatgggtaatcagttaacttttacccaccgttcaaaggatcagagttttctagtattctctccactcttctcgaaggacctagttctgatctttcttgatattatgattcataaagtgtagttcatgaatatttggatatgtatcattttgtctcatcagtgtctatgtgtgatgtgaagaacaggaggaggataaaattgcaaacagtgaacagcagaagctcaaagaacagccgacaatacatgattcatggtctgtagattcttctctgtacaattctcaaccatttatatctgttagaacaataatgtgagtgttattaagcaaacatacggaaaaaaacataaacttgtcacgttttggaaatgtatattcgagatctgaacacagttatgtttttcgtttatacatcatatttgtctctctatcaatttggggggagatcgaacagtccaacgctgtgcttatgttcgacagctcttataagttgttaagctgtatcaccttatgatcaatttgctttcaaaattctgtttttttgttcagaaatttcatttcgtaaagtgaacataataatcaaaccgtgaggttttctatcagatttcgcatctgttttgttcttcagtcagactcgagtcttgagagatctgtgtcggtgattaacgcggcataggagaataaacaaaacacgaaaataaatgttttttaatatttaaaaagcgtaacttttgacgttttaaggccgtaacccacttagcttgcttcactggaatcaacccgctaagctcgttctctactagatcccatccgaaaaatcctacttgcttcccaaagttgcaatctttgaggatctttgacataaccataaatatcctctggtaaatcttttgcctcaatattttttattcttccagcaagcctctttcgatctcattgcttaattctgggtattgcttttgatgtattactagtttgtgattttgttttggtggaacaaagttatttgattggatccatttttaacatttttaacattttgaactcttcttcgagtagtaagatccgagtgtttttgtatatgcttcagaggtaactcttgtttagtttggtccatatctagatctgtaactacgtgttggttcttgctctgctcaagtttagaaaattgtgtatataagctaacgaatttaatctcttgtgttgaccaaacaaaaaaatctcttgtgcctgaaaaatttgactgatttgtttttagtttatacttaacatttctactggttgtattgcgccagtttcatgtcttctttgtgattggtattttaggtggatgtgagtaaggttgcattgattccaaggac

SEQ ID NO: 659 - DNA, 3000 bp, Arabidopsis thaliana
ttctttcgccttcgttgcacccagaagaatttatcctcttttttgctttttttgtttctatttaaaaaggaaaaaaaaaattaagctaaccctagaagacgcaaaagcagacgtgatacgacaaaggaacgcgattgcgtgaagagacgagtgtcaaagtcgaagaatttatccgaagccgcaacaacaaaggatcaaacttctcttcacgaaaacctctttcaccactatacttaaacaattaatatcctcaattttcttcttcttcttcttcctcttccacttcgcttcttccttttttctaataaatttttgacattttcaataatggaaagttgcgcagaagcttctaatgtaagtttactctctcacgcaaacaccagagtcgaagaaccctttcgctcttcttcatctgttgtccaagacaagacaagataaagcctgttttgttataaaaagtaattattttaatttaatatttttatgggggaacggtaattctgtaagtatttcagtttcaccccaatagttttgtaaatggtttaatttacccctaacagatttaaaatttacacaaccggttacatttggttcggtttatttactttggtttttcacaaaaaaaaacacataacgcaaccataaattgtactgtatatggttttgagtaacggtatcaacatgaatttcgaacatgtaaaatcacattggatatacacaaaaataacaacacaaaagaataacaaaattatctttttggttcctaaaaaaatctgaatcttggcgatacggacaaacaaaaaaaagttcaatacaataaaattgtggagccaataaattactttcatttcttttgataccaaaacttataaccaaccttcaaaaccagcataactctactcgttaatcttgttatattcctagatttgaaccatcgtggccatataactgaaagctgaattcattgtgtaagtaacgtatgatatgataatactatatgtgtataaataggtggacacatatatgtatataaactaaatttggcatttcctatcatatgatatgataagcttgattggcatgtgatgtggattggaccacacaaacacacacacacagaagatgtccataggccataggcggtccattattattggtaagaaatgattaaattaagtatgcaaacaacttgacattgaaaatgatcttctgaaagtgatatttcaatgttttcacacaatcttgcccgtaaatggttgcatttaattgttactagatagaaaacggaaaaaaagaacaatttttttttttgtgtttttgtttttaatctctttctaattatgtttttgtgaataactgtgtgtttgattaatatattgttttcgagattcatcatataatatttgttacactctatagatgtgatagagttatctactacaccaataagatataagaaggccacattttgattgtaattgtatatatgaatatctgtggacaaaaaggtaacacttcacataattccaaaggctacgtaacatcagattggttgagcttccacatgggaattcggcaaatctgtaatcttctgtatatgccaaatatgtaattcttagacttaggaaaaaatggtcatctcttcaataataatacttctaattaaatggtcctcactaaaacaatgtttacttaataaaacgtataaacaaatagattttgttacatataaaagtataacctaaaatgcatgcagcaaatttctggattgttagcatatagctcagaacaatcggaaacaagatgtgctgccacctgaaacaaacatactaatatatgattattaagttgacatgacctaaggggaatctcgtgagattcgttttttgacaacttagctttggatccagaatcaaacatagcccacacaaatgaaaataggataacatggattccacaaactcttcacactttttatattatatatagtacttgtgattttataatataaaataaactatatcaatgatattagctagatatttaattcgcgttgaatgtggatactacaagagtttgatagattaaattgattcaagcaaatattttagtgggaatttgtaaaacactacatcttcgttatcgacttgggtatgagactaagagacaatatatatatattctattaaaaaaactcactgttacatgcgataaatggatgaataattcttgcttaattaagtttgagtatattactttgtttgtgacaaccgaaatagtgtcaagaacttcatatcactcggtggattactttatttgattgaatcttagttgataacgaaatcctttctttttctatgtatttcgattattaatgtaatcagaaaattttaagtattttttcacgttatccaactttgagagtactgtccttgtgttggccaataagtggttgaatatatggtaaaagtataaaagctcccatcatgttggacctactagctttgctatatataaaatgtcctgtcattgcataacgtaccactttctgaatctgttttacgtgcctatcaatgatttgtctttaacacttaccgtaatattctacaattaagttcaagtgcctagattttctaaatgtgtataaagacattatatatggcaaatgatcctttagataaccatttcatttaaatcaagcattcgattcgcattcatagataaaatactattcaccggtccagttctaactagccatccagtctggttagaaagcaaaattgtttattttattttaggttcagttttcagatcggttttctaacactgttttggtttggttctcgtatcggttcaaccggattggatagtcataaagaatttgaagtccttaattaagcccaaaacaagtagagcccatatatatactaacaaagccgtgattagggtttttggttttcgtcagaagatttcaaggtttagggtttctgcaattcaacc

SEQ ID NO: 660 - DNA, 3000 bp, Arabidopsis thaliana
gttttatttccgaatcttaagctggtgggttcgatcacatgcaaattacaattgtctattagtattacgtaaatacgaatatacatccatatgtaagaacacgtgtgtataactgtgtatatctccaatatacgtgcatctacatctataagtttacattgttttcgttatcttctacctaaatttattaattttcatttgggtcctattgttatgtcgattaataccctttaatttaggctgatgttctaagtccaaacatacaaacagccaatcttaacacaaaatcttaatctcagcatgcgggcaaaattgcgaccatacaactattatgctatgatggttctagtaataaaagcaggcatttagtttggaaaaaaagtaaaatctccttagagtactttaattagtaaccagtgctataaacgaattgtaaccaacacgcaatggaatcaataacactctattaacttaatatagatatgagaaactcgtgcttttaatctttgttaaaacgtcgacaaaaaaaaagtttttttctgttaattagttctcctctttttaaagttttaaatttttgatttcataactcactattaattgcgatatgtggggtcacctaagatcctccaagaacttatattcttgatgaacatatattgttcacaaattggaatcataatcttatcgtatgattgtatgtatatgtgtcacgtagttggacttttaaccactattagatctttccaaatatcctctctctttttttgcttcaaatttgttttttttgtgcacacacatcttatattattaatatataaaattggatgagctttataagagttttaattacatataggaaaaatagaactaattaataagatttagatatatgtataaacgtatttatatattgacatgtaagttttaaaataatatatcgtcatgggaaatatttttaaaaatcttaaaatacagtatggacttatatattcatactaaaacctagtggggtttttttttgtgtgtacatgaaaagtggtaaaagtattttctcttttttaattttgttagattaaaaatatgttaaggtagcttgttttgtttatcgtcatgtgttaaagtgtactatatggtaaagatttatacagtagcatgtgtaagcgggttcatgagtaggagagaattaaattctgccttaattaaacaaaggtttcgattagccgtacgtaccgccattaatagggagcataattatcacccattagggagcatactttgaccactaggggaaaattagaaacctatggtaatcgtattaattaatacggccaaaattaattctaattaacatataaaactgtttcccacaactaatttttatagatatatcaccttttagataaaatatagaaattctttcttcatatatatgttactaacaaataaaaatcataccgatgcaatgacctacaatctgaccggttagctcaacaactcagtatttgagaaatgtaattttgttcgattaccataggtttttatttgtataaatctaaatataatcatattacttctttttttatcgaaatataatcatattaactcacgcgaagaaactataataatccatctgacttctggttcgtaaatattgtcatacttaattagagacgaattgttctcatggtaatcagcaaaagatcgaatttcctaatttctaatactagtccagaaatatggtatagatttttatcataattttttttgtctagatataataaagtgtaaatggatagccacccacccactcctctcgtataatgtaaatttctcatttttttaatgatgccaaatccatataatcggaatttcaaccaccgtatttgggctatagatcataactaaagttatggaaataaatgaataaattaaaaaatgttaagtagaaaaaataagtatcaacaagagagaaggaagaagaagacataagctaacagttgtccgaaattgattttggcaaaaggtgatctttgattttgcttaaaacatcgaatcagaacatttaatttagttgtttcctcatttctttcatctatggagtttagtatacccaataaatttgattagttacttattccagctcctattattatatttaacacacataatgtaaaacagacgcgtataatttatatagaaactgtatgtagttaaaaacgacatactagtactgatgactctttgtttacgtaaatttgtattctcaaagaaaaaaagtaactaccttttgttatggtctctaagaaaaaacaaaagtactttacagttttcttagtgaccattctgtaagaatatcaaatagtgaaaaataggtaaacgagaatctttttttctgtgtaacaatattgtattagtgaaggattattaattacgagactattatctaaaacgcattagtgacccttttggatttaaatcgtagcagccgactaaaccaaaatatttagaaagttttccaaaaacaaacaacattaaaacacatttaaactcgtacacaataatagaaactaaactatttttagcagactaaagtctaaacaacattacgtttaaaaattgataatcagtgttttatagaactggcgatctcctaaagatgaaccaccgagaagtttcaagataaaaacaaaaataaaaatagccaaacactcttatctattcatccatttgcaggtcaatgacaccgtatttttccacaatcgaatcttccttattctttacacaaacttcttctctgtatgtaagtaaactaatattaaaattgaacttgtcaaagactttcctcttggtcacgtctgctatatatactccttcattcacacaaatgtttaactccaacacacttctctttctctcaacctctctccctctctctctccgattgtgtttttagagctgtcacgtgtcacgtgtcaggttcgaagctctaagaaaaaa

SEQ ID NO: 661 - DNA, 3000 bp, Arabidopsis thaliana
aaggaactgtacaacatacaagatttgcctatatctttcttggatacgttgcttcagtttgctatacttatggtgtactaattcatgagtgttgctttcaatcccaactacctcaacttgacaattaaaagaacacataagagcaagtagaaagagcatcatgaatatgttcaacgaatcctaatccggctttccttcttaaaacctcaaagttgactacaagattcataaaccattgactttccatatgcaatgtactactactactagcaagaatcaagatcaaatccaggaaaacaaaacaatattctaattcctcactatctttctagatctcaaagcttagggatcccaaattcgatccttattggaagactcaaatcacagacacaaattgttaaatttccacaagaatggttcctctgaacctgacattatcatttctcattgaaacaaccaattcacgtgccctccatagatactaactcacagatactagctcagagaccaaggaagtcaattgatagaagaaaatctgaagttatctatagtttctatgtgaacatcacccatttaaatcgttggagctaacacactatcaaatcaagaacaatttaaaatagagattaaaaagggagaactgaactggtggtctgagagaagacagcgagacgaagagcccaaatgttgaagaaaccaaaccaaacagaagctagtctcagtgaaccaaccaccattaaccaataccccaacgccttcatctccctcttcttccttcgtttactccttcctcgttatccaacaataccctaacgcatatattttccgttttaaaaccagaaaactatgagactgacaccaaaaaaaaacgtaaactcagattcggcggaaagattccccgatcagaacacgtaagccacggaggttaatttcgtacatttcagttagttctcaaaccaccggagaaactgtttgatgggccgacaatagttggagtctccgccgaattcgattattatttaattcagtgggtttcaaatgggcttttcaattgggcttctgtaatattctgatggacttctctacagttactactgtaaaaacaaaaatatggtttacgtaattttgtgttgctgaggcaagaagaagacatttccttcatcctctataaatgaatgtcattaaaaaacaaaaaaagcagaaaaaatacagctatcatccacgatcctcgttcagctacttatctaaacaaatactactactatataaaaaagaaattgaatctaagttgtcgtaaacgtgcacgcatatctctcgcccaatccccaaagaattctactttatttttattttattgactcgcacgcattatttaatttcttaatttagaaattttgtattctatataatacagaagctgcattctcagagcgaatagagtggtgagtttacctttgcagtagaagaaaaggtgactatttgatgtcatttttaaatgacggttcctcgaaactttaaaacaccttactaatttcatactgtacacaaatgtagaaaagttttgtggctctaaaaagtgtttgtttccttatttgatcaaacttttgtttctaggtgaatgtagaaaagttagaccgatggctattaataaccaaagacaattcaagaatactttgtggaaaataaccaagaacacttcactatggtgtaaataatgttaggaagtttatcattccaaaactcatgcacatgaagaaaatttaaatgtttcgtagtgttcatctttcatcactgttagcaaatacattggaaactagctacgccaattatgaaacggaactaaaaataaaataaatttaacagaagaaaaaagaaatctcttaatctgaataaaatgtgtgttaaggaaaaaccagaaaactatgagactgacacgaaaacgtgagttccgcatagaggcggaaagattctccccgatcaaggcactaatcagagcctcgaatgtacacgtaagcatcaagggtaatttcgtaaacttcaaagaagtggagccctatgtttttgtgtggttggtcacttatcaggtagagagagaaaccaaacaaaagaaaattacgtcaacctctctccgacctggcacttcttcgccagcctgttcccagctgtgctccaatgtcttttaattttctctaccagccctcaactaactctaaatttcggatttaccctttatccgtacgtattttaaatactcaaaacaaattgtttaaaaactttcaaatgtttaccaaagaaacattatttgccaaaataagcgtcacattcgagcagagagttacccaatctacatcattgttacgattaccggatgtttagccacaatttagggggctacttgaaataaaaaagaattagggacaaattttctcatttaattctttttttatgagagaataatggaatattcatgctctaataacaaactctttacaacatgacttatagttatagaatgtaattaaaaattattcaaatgattttttcatcggtggatgtagcttaaccgtctatattaatgaaaaaggggattaaagaacaaaattaaaaaggtttggtaccaatattaaagttgtggtataataaaggcgaattggacaatttaggaaaatacagcaaacgaaaggagggaatgcaaaaatgggaaaaatgtaaattgtgcttgcttgtttgtctccacttaaaaaccagagacatacacagaaagaccaagaagacgactgcttcctccaatggttaggtcgtgaatacggcgccattaaaacgctgcgttttatcgtcgtcacctccttttcctttgcctaattcccctaagtcatcgtctcttgaacggttcctgccattaatgtcgaactcttcctaaaccctttttgttcacatttccttctctttctcttcctccgtctctctctgaaaaaccctaattgactcgttgcgattgaa

SEQ ID NO: 662 - DNA, 3000 bp, Arabidopsis thaliana
ttgggctgtggcgggtccagactgttttgagaagcgagctgctcggttattgtgagttcgagtatatatgcaggtggctcgtggtggcgacgggagagaatgctgagaaagtggtgccggagtttgagggtttagaagattttggtggtgatgttcttcacgctggagattataaatccggcgagaggtaccgcggaaaacgagttctcgtagttggatgtggaaactcaggcatggaagtctctcttgatctatgcaatcatgatgcgagcccatcaatggtcgttcgaagctccgtaagtaaaattcagtaaattatacccaccaagttacgaaaaacagagcaccctgattcttagtagctcctctgtttaaaacagagcatctgatagttatactctgtttttccttgttcgatcaggttcatgtattaccgagagaagttcttgggaagtcgacgttcgagttaagtgtaacaatgatgaaatggatgccggtttggctcgtggacaagactcttctcgttctcacaaggttacttctagggaacaccgataagtatgggctcaagaggcctgaaattggaccgttagagctgaagaacaccgcaggtaaaactcccgtgctagacatcggagccatttcaatgatcaaatcaggaaagatcaaaatcgtagcgggaatagctaagtttggtccgggaaaggtcgaactcgtggatggtcgagttctgcagattgattcagtgattcttgccactggttacagaagcaatgtcccttcatggcttaaggtagacaaaagtattatctttttcagatttttgtctcaaaagataacattttataggaccatagaataccggtattgatagttatgggaagtttgataaaaactaagacgttgattggtgattgatttattgttatgcaggaaaacgacttgggtgagattgggatagagaaaaacccatttccaaaagggtggaaagggaaggctggattgtatgcggtgggattcaccggaagaggactctcaggtgcatcgttcgatgcaatgagtgtagctcatgacattgccaatagctggaaagaagaaactaagcaacagatcaaaactgtcgctactcgccaccgtcgttgtatttcacacttttgattttcactgtttatacgaaaacatatatgagaagaggtaaaaaagagaggatcgatagtgttatgtgatgtgaaaatcaaagagataagcccactccatgagagtataactgtgaaatgtgtttgagcttattttcttgtaaggaggatgtggctccatgtatttaacgtattctttaacattccaacttatcttttgttagcaaatgtgtttgattagagctgatctagaaagtttaaaacatgattagtttaaacaaaatatatgaacatgtgtctgaaactgatttcgtcattgacagaaataagtgaatgagggaaaaataccgaaaacattcctccgtaccgtaccagcaatacatgaactgtgtatgtatcatttctcttattatacgatggaaatatagagacaacaaacatcaaggttctaaaatgcttaaacaaacattcattcatcatcatcaaaaggagccattgaaattttaccagacatcaggacgaagctctccggtagctggaggcatccaacgaccagaattgtacacgttttcaccgactttccatccaggaacatccttcatcacatccgcctcgtattctagatacttcttccactcagacacaaacctatttacaaatcaacacgtggtgatccaatgtgagagtttgtaccacacaagcaaacataacttcttttgtgaatcctacctttcatcttcttcagcttgaagaatcggtagaattgctctacgtgcagcgtacttctcttccttcaacgccctatcatcacagcaatcttcattaaaactttggagttgatacattgtgctcattttgacacttttgtcatcattatgcaattgagagtctaacaatagaagactattagagaatgtcacttacacacaccaagaaagataacactgtgttgtcttattcgttgcaaattactccaaatcgacactaatcaagctaaataactcacaatgtgaccatctaaaaaccaatatgcaactaaccactagtatatcatcttgcaatttgattgctttcttcatcacagctcaagagatcgttaattagtaaccaatttcgagactaaccacacaaatttataagcatcaatcccaaattgtcttaagattcaatcccaaattactcaaaatttcacaatagagaaaagcctaaccaaactcaaattccacatctcattatctaattacctgcggattttgttgccctgaccaacttggtacatgccccaagcaaaagcaccggaaacggtaaggaaaatagccatggcgctaggtcccgtgttggagatccggcgagcatatcggaccggcgcgaatccaccaggtggtggaccatcctgaagcaacggcatatccttcacactcgccattcctggcttcttccttatcatcgcctccgtcatcttcttcctcgattgatccccaaatcgatctttgattcgttaatcagtgtgtgttctagggattctgagaaagacaatcagaaatgaaatgaaatgaaaaatcttttttttggtgactttttttttaaaatgttgtaataatgaactgggctttaaaaggcccatattaaaatagtaccgggtcaaaactcgaaccggatccaaaaccggaggctaaaactcgaccaagcaatgatgagcttggagaaaacgtaaaaccctaaaccctactgcttatagaatcttcgacgatctgcttcatttctcctcatctacgagtgagagaatttgtcaatttagcttctttagttcggtctgatctgaattaattgcaatcttctcggttgtgtgagagaatcaatcacc

SEQ ID NO: 663 - DNA, 3000 bp, Arabidopsis thaliana
atcagtttcctcccaatcttcggtccaaccaccacgttcatcgcgtgtgaaaacataaacgctggccctgaagctccctataatccatattcaaaaacattttgcattttataaccaatggagattatgaagagacttgatcatctctagaaaatcatccgataagaaatgaaaaagtgattttttttggtaaagctataacattctttagttttttttttttgttaccacaaattttttggagatgagatcttcaccgagagctagtggattctcgcagtttctgcaaaaatacgtaggaagagttttgtttgctgccattggtcgatgaatgtagaaaggaaatcagaaagtttgtaagattggatgagagactatgaagattatttgttcttatcgtttagttcttgtggaatttctagtgcgttgaccccgaccacttgcattattgtatgttgttggactaatgggccatttatggtgtataaataaaggcccatttgaataattcacttgtgaaacaagattaaaagacccacaaatttgatatattgatgggcccatccgtgtggtcattatttagcggtgatggactgtgtgtctttatacaccgagacttggtccaatcacgttctgactgagacttgcacacgcatcggtgaccggtggttttgagattatgcgtttactgctaccagcccattcacatgtacattaacacgtaataatgcatttactgcaccagcccattcacatgtacattctaattctcagtttgtgtgtgtgtatattgtatataagttgtgaaaaaaggaggagccgatgaagtgatattcttttttagtttaaggtcggtgtttgattttaatgaccaaacatctcttttcaacactagtttcattttcactgtcaattcttataagtattcattcaataaagtaacgatgctgatatttttagaattatcttaagacaaacaatatagaaagtcttttgtctggtgtctagctttagattttggagcctactttaaagtcgtctccaagtgatttccagctaaacagtggtcacattaaataaaataacgagggtagcctcgttttcatattcatcctttaaaaagcagaaaaagcacattcacttcttgtgatccacacacttctcatttaccatatccatattctgtaaaatgtaaatgttgctaaccatacaatttcctcttttttatctgactcaaaattttctatgttatttacttaaactggattctgatcaattatggttcttataagttggttttagggttttaaattataatgattaattcaaacctaaaaaaaagttacgatgattaataatgttttgttcggtacatgttacatttatcggcttattttgttggaaatgttagttgggatatatttgtttagttaacccgtgtaaagagtccttatttggtcattaggttaggtgtatcagtatatgtaatgacatagcacttgtccattgtcccaagtcgcaatcgtcatcatttctacaagcatgaagcatctttttgaatctaaagtcttaattcacattgtgcttttatttccctgtccctacatatcataaaacgacatgtcttatcaaatcatcgacatacttatttgaaagtcacgtctaaaggataacctaagttctcaaaagccgtatatagttcggttcctgcatttttttggatccatcttagaaaccctaaaccataagaactgtagacgttcaatttcttacagaaatttatcaactccatgacaccaaatttaagtattttcgagaaacatacagagtatatatatcagtaacaattcagtatttgattcaatttattaaactatttcgatatatgtgcctagatggggtactaaactaggaagagtggacctgcgactgcaaatatatcaagtggcgcatgatttagtagcaacttgaattctataaacaagttgccgtacgtttttcccgataataatttgggtgttccgatccatttataaattagaagacgacgaaatactcatactgacccaaaagtctttgttttgaattaatatccgacttatgtatttatacagttttgatgtgatctctaaccaaagttgaccataaggttattgcttgttattaccgttagaataaaagtttcattgacacttgctaaaatcaattattcaatgtatatattgctaattacatatcattaacggtctagttagatacatacaaggttttcggtgacaataaatttgtgtacagctggaatggcaatgatcaccaaaatatttatttcagtctatttagattcttcaccattgatgacaaattcataatcatattggtttcgttgactagaagttagaacacataaataatctaatggaatgtgattgaaccgttgttatatcagtattcgaatttaacacctttaaatattgaataatatttaatatacaccacatttgtgccgtgaactccgttacccattacaaccagatgcattattatttttatactctcgagtgaaaacaagtaaaaccaattgttttctttttcgacgtttcatatatatcttatgcttctgtatattaatctattaataataatctgactctttttttgttggcttcctttgtctaattttgaaattacaaaactatgtatcgtcttagctgttttttccctcctacacacttgacccatcggccatcacttgtcgttttccactctgatttattctctttcttctacaaaaaattcaaacattacaagccatgtatatttttattatttcagtaataacatgcgagtgagaaaatagtataaatattagtggaaaaagacagacttccttaatggatataaacatcaaaattcaataattgcgatagagtatcaatcaagatcttacatataaaaaaagattcatcccccaaagaacggaacactcactcttctaaaacg

SEQ ID NO: 664 - DNA, 3000 bp, Arabidopsis thaliana
aaagagcatcatcaaggataaactctctgtacgcagcaagaaagataaagttattgatctttctaaagatgagaagatcgaaaaagtcagtgtttctttcttctcgcgtgaatgatactcgttttatcattgttctcttactgtatttcctcacgagatgcagataatgcgtgctgaaacgtgtgatgagctacacaatattgttggtgaggatttctgggtggctacttggtgcgacagtaccggatctgaagggtgggtttgttgatttgtcccgtaattctcttcactgaagattttctgttatgttgattttgctttctttgttcatatcttcaggaaacgcctcgaaggaactagaatcacctgcattcaaaaaccgtaaattttactttttgttgcatgtgattaacacaaatcctaatcacaccactttcttcaataaatttctctcgtgtttatccaggggaaggctggggtatgatttttcaattcgaactccatgtacacctgcaaggtggagcgactttgatgaagaaatgacctcagcttgggaggtaagacctaagcatatgcaaataattggtatttcttttgtttctgagaaaacaaactcaaaagtctaactgaatccacaggctttatgcactgcctattgtggagagaactatggttctactgagctcgacgctttagaaaccgttagagacgccatcttacgcatgacatattactggtaaacgactatgacaacctaacgtatgattgattaattactcggaagctgttggtatttaatagcaatcattggtttttttaccaggtacaattttatgccattagctcgaggaactgctgtaacaggatttgtagtgttacttggacttctgcttgctgctaatatggagttcactgagactatcccgaaagggttacagatcgattgggaagctatacttaatgtcgaaccgggttcctttgttgattcggttaagtcttggttatacccgtccctgaaaatcaatacgtcgtggagagaccatacggaaatttcctcggctttttcgacaacaggagcggttgttgctgcgcttagcacttacaacgattgagattcaaatctctctctctctgtctctccttctctctctgtctctctgtgtctctctcacaatctttcataagaggtgaagaaggctaactaaaccatgagcagtaagaaaacttgtgtttcagtcaaacatcttccgtctgtttctgatctaaaaaacaaaaaaaaagctagaaaagctttgttagggttttaactttattaactctcgtgtttaatataattttacagatttaataatgtatctaaatatgatttctctggtctcaacatgagaggttccaacatgagagtttacaacccttggccgatcttatgttgttttaagtttattctgacacctctttttttaatacaatcttctgtctgctctgattgacagcattgataccatgatcatataaccgttgcatgtttctgaaatcaatctcaaaataattgcttcatagtaaaaaatgattacaagattcgagtttcatttattatcgttataacactcactgtctcattcgtcaaagtctttaacaaagtcaacgaacgaccattagcttgggctttctctccaccgacgcgccgctctcagaatttccacttactcattgtctttatattcaaaaactcaaaaaaaaaaaagtattaagaatggcttaagaccgaaacgtgttttctcctagtctggcaaaacacaaaataataaatataaggaaacgcttatgaatacttttcaatattctacataaagtcattgaaagaaggattggaacaaagtgagaagcaacaaaaagaaatcaaaatcgtagctcctaagcaatacgtttcttcattggcaacggttttgattccatttcgactcgaatgaaaaaaggccaaagagtattcaggcaattacggtgacggtggcaacaaattatagattaaaacgagccaaaatagaagaaagtgccaacaaatccgtgtgggcaccaatccaaagtggcaaaatcaatcaaccagctgtcctctccctctaacttccgatcaaagactctctttttttttgtttacgttttcttttcctcattctccttgtcttattttgattgcattatattgaacttgagtttaatcatttttcattattaaggttatttatttatagacgcatgatgcatcaagtcataataatttcacccgtgatgatcacataataatactaatccaagactccatgtgtcgtaccccaaaaatttatctcaattatactatgtaccttatattgtgctatttttttaactaataatttcccgacaatttagtagttggaaatttctcgaccgtgtgatataatctataatataaaatatcataattattaaacaatgataaaatttgtgagcgacattggtatcaatttcaaatccaattattatgttgacacaagactagtgatttatagtataaccaatttaatgtctaacgtaaaaacaattactattaattgattttctatatctgatcatatgttcaacaaaacacatgctaatctacccaccattggcgaataaatttattgcagaatataacaggagaaaaatgccaagaaaaaaaaatccttataaaaacgcacaagaaaaaagtaaaagagctattctgtaaaataaaaatgaaaaaagtattgaatcctacattaatagatacaggatatgatgttctgtttctcaacggctacatctgtctgtgatccttttttaatccaacgatccagatctctcctcatcgcctatataaaactcacttctcttacatcaaacaaacaacacgcttggttaaactccatcagtactttaaccatcacttcaaagttcaaactcttttttttttttttgtttgatccaaattttaacaaaatt

SEQ ID NO: 665 - DNA, 3000 bp, Arabidopsis thaliana
tttaatgcgttagttgagagtatctataaataattgaccctttttcattttaggataatgttttaatttaaataagttataccaatctaaaatcagcaaaaagaaaacaaaacatactataataaaattttcggaaacacaaataccatgaacatgcaagtgcaactaaacaaatgttttattatattaagttaacgtcacagtcaagtctttgggtcagaatccatcgttctcggacagtctgcgtttttaccgtttacgcattttccatagcattccatagtctttgggtcagaatccatcgttaccgtttacctatattaagtttactgtattctccaaccaacaccatattttattaaaaaaaaatttatttacatatattacaaaaccatattaaaaattaaatataaatatattacttttttgttaaaaaaaaataatatatatattacttttgtgatatataattttttataattctaaccaatagtattcaataaatttttgtgaagtttacaattctttaagaataactaataaatattgataaaagtactgtacttatctttttgaaacaacaaaattcctaaaaaaacaatactgtaacaaggagcagaaaagtattatattaaatcaaatactaacaaaataatagctagtatttgataactagtttgtttagtaatacaaacaaaaaaatgttaaatgaaatgcaaaactctttaccattttacgatttttgaaacaaactttttttttactataaaatacaatactgtaacaaaaacaaagggagtattatattgaatcaaaatacaaacaaaataatagctagtctttgataactagttagtaacacaaacaaaaaagtgtaaaaccaactgcaaaattctttacgattttaaatgcaacatcttaaggtggaccatgatggatgattcatgagtcttgactcttcttgaggctcaattatttgggcgtgttgaccaaaaaattgttccattgaaacaattttttctatatcctcatcaaatacatttttaaaatatgttgacaaaaaaaaaaagagaaaaatgcgtactataaatttatgagatctcagtctattaaacaaagaaaaatgttacatctccaactttacaaaaagctgattttatttcttctcatatttttctactggaaatgcaggtgtgttaatgataagtatgtgtagtaaaaattcaaacacaaaaatgatttatgataatgcattgtagattcacatattataaaggtgtaataattgaacaaattaggctcaatcctagtaacggaagcacttgctcttcgcaatgcccttaaaatggcagccgatcaatcggatatagcctctttcacggtattgttggactctcaagtcttgatctcacttatcaatgctaagaaatatctttcaaatctcaaagaaaatcatccatgatattgcttcgttttgtaattctttcgcttctatctctattgcttatgtcccaaagtcgtccaatactttagccgactccttagttaagtcagtccttgtggcttttacttcctcctcccctccaagaatgtaacactctctgtcttttagcaatgcaagttcggtttgaacaaaaacaaattatcacaaaatgccaaaaaatgaaagacaattaatttataattaggctcataagtcaaatagccaataacttgccccatacctaagatagttactttaggcgaaacgacggagaatttaaggacaattgactatagaaaagactctatattatactattcacagtgtcccaaatatatataaattgcctaacacattgccaccgtcgttgacaagttttcttagattcaaaatttagtacatagtatatattatataatttataaacctaagaaatgaaggaaggtggatcttaatatgtataattaatagaggcaagacatgaaggaagatggatctttaccaaaaacagctgggcagctttgaaaatgcaatgttcgatgataataatatctcaataacaaacaacgcgtttttatctcagaagactccaatatattgacttggaaccactaaaagtcgcattattattgttttgttatatatatatataatcccaaaaagtaaacaaacaaaaaataaaatacaaactattgcggaacaatacaatatatatatatatatatatgtaattcttattgattcaattttgaaagaaatttctttgtctatatattattttgatgtttttgtgtttaacctcatgaatagagagataattctccggcttggtaaacaaatacgttggattgtttttttacaaacaaaatctcaatatatttctaactttagccctacgaaccaaactacaggtcaataaacgacgtgaaatcaagctaaatggcaaattattagaattagtccgaataataaacaaattcgtctaaaattgtagaaaattttgggatctaagaatgagactacatcatttttttttatcaacaactacatcattttaaaccaaacttagaattgttaggtctcaaacttctaacaccgatttgctgcaaaaacaattatggatcggatcaagatatagagaggatttcacatttgacttctattgcttactcattccaaaagacggtttggtctagtttttgaaatttaaccaatcttgaaaatacggaatttgtaatgtactttacaaaaattgtatatgctaattataattttgtgatctcaaatattcatgtttatatgataagataagagataacatgaatgcattattatataataccatagaagatagaatgtatacagtctcaaaataacaaaatttaatacggacccacatcccaaacctctcccactctatatatttggtctctataaaacccactaaacctaaacttttccaaaatcataccaaaaaaacatttagtaacatcaaaatttacaaaaaacaaaaaaac

SEQ ID NO: 666 - DNA, 3000 bp, Arabidopsis thaliana
tctccgatgagtttgtttgccattttttgttttcgtctccggcgtcggaaatattctttagacggtgaagagattagagaagcttctctttctctctcccgccaaattgagagtcctttccttactaaaccatattgggccttaaagagatgattaggcctgacccgttttgtattatccatgacccggaccatatttaagattcgttttgggccttttgggttttgccgttttggctatcaaaataaataatattttggcgaaaaatttaaaatgaataccacattcataaagtatatttttttgtttgtaaaatcgattttttttttttacaattttatgccaaataatgtttactaaaaattataatatattatagcttttgtttcctgactatcctttatgtgaaaatttgaaatagtaaataaaatttgagtgaatggtaacgacataaactcaatttttgtttgaatctatgaatgcattataaaaaaatttgatcgaatagaaaaatataaatcttaataatgtataaacaataaacgttgatatcattgttgaccaaaaataaaacgatacaagccaaaagatataaataattaagttgcggattctgtttatattgtaatttttattgaacttataataatattccgaggaactagcaagtctttttcaaaacattggatccagctaagcagtgtatctttgttaactctggtttaaatttgattttgagtagtttatatttgtttgatgtgctttgaacttttaagattttcttatttggtcaagtataaaagaaggaaagtggaaaaagtgaaggaacgtcacaaataacgtgcatgattagtatttgataaaccaatgacatattaatatcaggattaatccacagaaagttgaatagacaaacaactacaataaaatttaacattttaattatagttgttgagtatataaataaataagatactctttgtagaggttttagtccaaccatcaaaataaaaacgcgtgaactttaaaaaccaactcagaatatgacaatgaaagagttaacacaatcaatctaatgggagcctgaccattggattgggagaagctatagtgattgatgagctttgtaagagctacgattcgtcacatggtttctttttggccattgtgaacgttttaaaattgtatttcactaatcgtacttctaggtacataaaagtgtatacaactagggaaactcattaagctatacaatccaaaagtctgagctagtgataaatggaaggacggtctaattaatgtgattcatgtttggatgatttgaagtcatgaaagctcataaaaagctttagaatggggtcataccaattcaataaggacggtggatgaagtctttttgacatttttgttggtccacttaattatattatattgatgaattcgttatatgagagtgatactttacaactacaatgaatttcctagaatattcattcggtaaagttattaaaaattcgaatatataggccaaaaaacaaatttgagaggttaaaaatactaagaaaatgttaatggttgtggacatgacgaaaatgtggctcttgatctgaaattcaaaatctttgtagtaaaaattgaatatgtcgcttgtttggttaataaacttcaaatgcttatttttgtttttctaaaaaatctacaaaaattggatgctgttaaaatgataaatctaaatgcaatctcaatgtagaaaacatattgtctaatactacacaaacttgcggtccaaatggtaaaaccatatactatacttttaaactaccagattaaaagcaattacatatttaaacgtgtttaaatcactttacgaaatacatttttctctatggtaagagaaaacaaaagaaatgttttctttcaccaaagtcaacgaccgaacttgctcgagactttcctttcttcatctagaaactaactaaactaaattgtgaaacaacccaaaaagctaaactaaaataaattcacattatctgtaaaaaactaaaaacacttcatattgtcactaaatcttactacacatctttagtgatgcaattttcataacattgaagtttggatcatcttaaatcttaaatatatgaaacgttatcatcccttagactaaggttcatgagtttctaattggactagtctatatatgcaccaactctatagtttattaatgaaaatataatgaacattatattttgttttaatatgaagactctcttttgtttccattagagtttggcaatggattttaaataagatgattcctttttgttttatttcatttatcacttaccttgatctacttcaacttgtttcgtgacttttaggtgcatgaccccaagtattcacacacacacacacgtattcataagcttcttagaacacctccagtggtgtttcttaaagcattcttgaatattcatgacaaaagtacaaggtattataaaatattaataaaatataatatgtgcccctagaaaccattgacccaccatgcattctgaataaacaccgaaccttaccacatttctgagcaatttttccacagaagaccaattcctaatcatgtttaataattaattaatttggattttggagctatctttactctttctttgcctataaattaaactccatctctcttcttatccttctacttttctttcctcttctcagcaaaaaaacatttttagtaacatttgttctaataagaaatttgtctcttgctttaacaagaagcaagactagccttatctgtacctttctttctgaattaaagaaccctttaagattcatatgattttcttaattcttttttatatatgtagatttgtttcttaaacactatatttatgttttacaataattgttttatatgttttcaacttctttgtagatttgcttcttacacacactaatgttttatctttgcagagaaacttgacattt

SEQ ID NO: 667 - DNA, 3000 bp, Arabidopsis thaliana
actgtttttttcagttctgtattttctccgaaacgaattggaggtccagatggccggaacttgcagctgcatttcaagtctagattatctctccctttattcactggaggaagagtggaaggagagcaaggtgctactatccatgttgtattgattgatgcaaacacgggtcgtcctgtaacagttggaccagaagcttccctgaagcttgaggttgttgttcttgggggtgactttaacaatgaagatgatgaagattggacccaggaagagtttgaaagtcatgttgtaaaagagcgtgaaggaaagagacctttgcttactggagacttgtttgttgttctcaaggaaggggtaggcactttgggtgagattgttttcacggataattcgagttggattagaagtcgcaagttcaggcttggtttgagggtaccctctgggtactgtgatggcatacgtatacgtgaagcaaaaacagaagctttctctgttaaagatcacaggggcgaatgtatgtgttttcttttcttgttctctttttgccttgtgcttgccacttgttttcttctaaatcaacatgttgttggattggttatgtgtagtgtacaagaagcattatccacctgctttgaatgatgaggtgtggaggttagagaagattggtaaagatggggcgtttcataagaggctaaccgctgcaggaatagtcactgtggaaggctttctgagacaattggtcagagattctacaaaattacgggctgtgagtgcctcctattacgtcaagctcattgttgttggatgagaacattcattcaatgctcatgagtaattatgattatttgatatttgtctagattcttggaagtggcatgtcaaataagatgtgggatttgctagtggagcatgcaaaaacatgtgtcctaagcggtaagctttatatctactatactgaagattcaaggtctgttggcgttgtattcaataacatctacgagttaagtggcctcataactgaagaccaatacttatctgctgattcactctctgaaagccaaaaggtctatttcattctccttattttcttacacttatttgcctcatgatgtttggtatattgttctggaaaactctgatttacagatttttgttttggtgatgtgtgattatatagttcagttctgttatatatatgcggtagtgtaaattttttggtgtttaaatctgaaaggtatatgtggatggactggtgaagaaagcgtatgaaaattggaaccaggtcgtggagtatgaaggcgaatctcttttaaacttaaaccagcctgagaggttggatatttctcagactgatcctgtaacagctctggcaagttactctacggtgcctcttagtcagtttcctgaattcgctatagaaggttggcaaatcagtcccttgtaatattactaaatctcaaatcttatgttctttgttctgtatcataagtttatattctacttctatctttactgcagggtataatcaaacgctgacaacagccctacctcataacccacaagcacaatttgattttgttccccagcaagatcagtttatcggaatacagcaacctcaaactcaaaccaacatagagaatgaaaatgtaactaggttggttcttggtcctccacaatcatccacaggtgggtaccaagacatcaaatcttctgctgaccaggaaaatcttaatcctttcgaagactggacaaacctaagtgagaatgactttttctcggaggaagagatccggcaaacaagccatgacttgttagcgaatgaggacatgcaacagttgctcttcagcatgggaggtggcaaaggagaagatggttttactttcccatcgtttatgcagaatacaccaatgatgcagggatatgatgaggagggccgtgggcgatcaggaaaagcggttgttggatggctgaaggtaaaagctgctatgagatggggattcttcataaggaggaaagctgctgagaggagagcacagattgtggagcttcatgataataacgatggtaaatgaatagtcaggttgcttgctagtgtatagaagccatgtacagtttagggatgtataacaacatcacttaccgatatggatttgcttgatttagcttattagacaagaatataatcgatgaaccatgagaaatttgaagactaaccttcagcagcaagacaagaagctgattttctgtctctttaagtttcaactttcaacttgcagatatattagaagactgactaagtatgggcctataagcccattaatgtctctactgaacgcccaacttgtgaaaaacatgtctctcatctcaattttgttttcttttcacatcaacttaaagctacgagaaccaaacaagtgatgtttttggtcaaacaggacgaaacatgtatacataaaaagaggtaattatgttcgataaacataggtataaataaactataagaatttgttacaacattctttagatttgatattaactgctgtttacatttgaagaactcagttagttatttaatattttattttatagggtctagaaattacttgcgtgtggggactgatcaccgattctaaagaaggctcatcctttggataatagtatgaaacttgtcaataaagataagtcatcacaagtagggagatcttagctgtgttccatacgcccatctagaaaaagcgacgatggtcaagattaaataactgtatttgaaaaaccaaaaccgcgtcaccaactccaaagccattaccattagccatcactttccatcttccagctgttcgaatcaggacgcccctttttcttcaccaaacccatcggccgataacgaaccttcctctctgactgcctctgctcttactataaatacaaccaatacgacctcatccaaaacccaacaaacctaagctcaaagcccaccaaaaagaaaacaatcacttagca

SEQ ID NO: 668 - DNA, 3000 bp, Arabidopsis thaliana
attgaggtacgttcccttagtttaaaagttaagacaaggttgagttagaaaggtctggtgtttatgtaataatatattgctgcaatatccaggtgaagaaaatggcgattcataaaatcagcgaagctgtaaaggaaattcgggaactcacatcttcggattcaactggtgcattgagattatataactagagctagaggtaccaatcttgattcttgaccattggtaattaccctattcttctgggaaagattcagctgttgagtttcaaggagtcgtagaatgtaaaaatatatagaaataaagagacaatagctaagagaaagaaaaaaaaaagaattcatttaccattccgattgttgttggatgatataaagaagcattgatatcaaatttgatagtggaaaatatcttgattatacaaaagtctaattacatatgttggtttgttattgttgacaacctaatgatcatatatacacaacttagttacaaatattgacttgcttgggctcattttgttctaagaacaatcttaccttttgcatcgtcatgcataattggtagaactatctccggaggctgaaccctccagactttaggatcctgaaactgatgtcctaacttagccaatttatcagcgactcgatttccttctctgtaaacatggctcaacacgcagttgttcagctcaggcataaccactttgatgtaattcacatgcttatttgtcttttcacatctcaatctccccctcctcgagatgatatccattatgatcttggcatctccttcaagccatagatccgtcaacccgttctctagagccagctcgagccctcttttgagggctgcgaattctgccatggtgcttgtggcttcccctatggattctgagtacccaagaaggaactcggctttgtggtttctgaatacccctccaatgctggcttgtccttctcttcctctggatccgtcaaagtttagctttatccgtccattttcaggtttcttccacacaactttgacaggctgtttgtggtagtctcggattaacaataaagtagcccgggtttgcagcaacccttggaatctagcaatctttgtgaaagctaacatagggtttaatttttttggtaacagattttcttgtcgtaaaaaatggtcgactcagatatttcttttggctctatagtcgtggtgttataccaagagtaggcaatattgtggaaggggtttgttagggaaatgatccttgcaaggaaagcaaagaatgatccttaattgaattgaaagggaaggcacatttgcagaatttagtaagcagtgttatatgaggaatgttttgaagaatgattctgtttcaatggagattttaagtagaagaagttttaacgaagaaaatttaaataaacatgactacttttgtcttatccctaaaatactgaaggtctctcctcaacctcaggaggatctctctttctctctccctctctagaaacttgcaagcaaagaaggaatgagaaacagagttacccacatttcccggaaacataataagttcttatacatgaagttattatttatgttggttctgtttacgaagcaagattcacaacatatcaaacaactaagaaatgattcaatatagagaacacttgtcatactggaggccacttgtcataaaaagaaaaactgatgagtctttagtgtccaagaaacagatcgatcgatccccactaagacattgtctgatacttttttcccatacatcgtggatccattccctcttcgaccaaacttccacaggttcaaaccaaaccggaaatcacagagttcggtttacaactcaagaacctaaattaaaaggatcctaaaaccagagacaaatagataagcaaaccgaaccgttgaccctgtcaaaaatacgtaagttcagcattaccgatccggttattatattattcgacccggtccgagattatttttgttcataaagtggaaccgtcctcactctatccctcagcttaatccgccgtcgttggttcaaacgacggtcgtattgatcttcgctgattggatctttataatccgtacaaactcccggagctcttggcctatcaatgtccgggattgatggagctatccaaaccagctgctctgttacgcacctctggaaccacggcgataagcaaaggcgtcgaattgactcatcacgggaacttcattactttgctgttatttccaagcaaaggattgtgaaaaagtatgaattttcttcattatagtacatgcaggagttatgttttctgtgctgaaaaaaataacattttttcttggtttctggtttgcaaattgcaggtttctcgattgaagaggtagctagtaaagttccaattgcatttctttgatgcattaacaaagcattcagatttgaggtctcattcagcgagtaagatccaagacataaagatcttccacaatccgcacctcataagtataaattcaaatacagcaggagggatgtgaaaaaaaaaaggagtctctaggatgtccttaagtagtttatttcccattaatggaagattagttttagtttctagttggttaaagtttcagactttgagttcttattggtcctggagagaaaagaagtgagaaatataaacttattttaaatgttttcttgtaacttataacttcttatttcacacaccgttgacctgattcgttgcaccaactcctaaatttttatattgaaatttttatatatcatcatgcaggacccaacaagcttacaatggctgtccacttgtgtctgtctgttactgaaatttataattgtttttgatcagcaacttgtgttctttcggctgtgagctagtttaaagaacacacggcttttttttaaggtcaaattaggtcgacatttaccatataaagactcattacacactggtgggtttctcatagattagagaaaaaaagcttcaagctttc

SEQ ID NO: 669 - DNA, 27 bp, Artificial sequence
  Single strand DNA oligonucleotide
gacgatgtttctgtgattgtgattttc

SEQ ID NO: 670 - DNA, 28 bp, Artificial sequence
  Single strand DNA oligonucleotide
atttttctcgagaaaattcaaattgaag

SEQ ID NO: 671 - DNA, 28 bp, Artificial sequence
  Single strand DNA oligonucleotide
gaagatctttctctaatataaaaatcag

SEQ ID NO: 672 - DNA, 23 bp, Artificial sequence
  Single strand DNA oligonucleotide
tctgatctgaacatgttatccag

SEQ ID NO: 673 - protein, 301 aa, Agrobacterium tumefaciens
MTNCFQGDSHAPHFVEKQVAFWEEPKATCSSRRNIEEENITASGTDFSCAKKSICIQHIARPMDLRLIFGPTCTGKTSTAIALAQQTGLPVLSLDRVQCCPQLSTGSGRPTVEELKGTTRLYLDDRPLVKGIITAKQAHERLIAEVHNHEAKGGLILEGGSISLLRCMAQSRYWNADFRWHIIRNELADEESFMSVAKTRVKQMLRPSAGLSIIQELVQLWREPRLRPILEGIDGYRYALLFATQNQITPDMLLQLDADMENKLIHGIAQEFLIHARRQEQKFPLVGATAVEAFEGPPFRM

SEQ ID NO: 674 - protein, 240 aa, Agrobacterium tumefaciens str. C58
MDLRLIFGPTCTGKTSTAVALAQQTGLPVLSLDRVQCCPQLSTGSGRPTVEELKGTSRLYLDDRPLVKGIIAAKQAHERLMGEVYNYEAHGGLILEGGSISLLKCMAQSSYWSADFRWHIIRHELADEETFMNVAKARVKQMLRPAAGLSIIQELVDLWKEPRLRPILKEIDGYRYAMLFASQNQITSDMLLQLDADMEDKLIHGIAQEYLIHARRQEQKFPRVNAAAYDGFEGHPFGMY

SEQ ID NO: 675 - protein, 240 aa, Agrobacterium tumefaciens
MDLHLIFGPTCTGKTTTAIALAQQTGLPVLSLDRVQCCPQLSTGSGRPTVEELKGTTRLYLDDRPLVEGIIAAKQAHHRLIEEVYNHEANGGLILEGGSTSLLNCMARNSYWSADFRWHIIRHKLPDQETFMKAAKARVKQMLHPAAGHSIIQELVYLWNEPRLRPILKEIDGYRYAMLFASQNQITADMLLQLDANMEGKLINGIAQEYFIHARQQEQKFPQVNAAAFDGFEGHPFGMY

SEQ ID NO: 676 - protein, 342 aa, Glycine max
MNISTSACACACACKQELPLVSFQKGSLMMESLFHHRNNSNKDKVVVIMGATGAGKTKLAIDVAKHFQPAEIVNSDKMQVYKGLDITTNKVTEEECGGVPHHLLGTVDPYINFSANDFCRYATLAIDSIVEKNGLPIIAGGSNSYLDALVNHYPEFRLRYQCCFLWVDVALPVLHSSLQARVDRMIEAGQVNDVRDFFDPSVTDYTKGIRRAIGVPEFDDFLRAEANGRLDERTKQRLLQAAIARLKINNCTLANRQIQKIHRLHAFWKRNMHRLDATEVFRGSRDAWRDHVLAKTLIILHKFLYGEKKTPHVVPAGIVSAKDVIAAAAVLSSPPVAMAATR

SEQ ID NO: 677 - protein, 441 aa, Zea mays
MRRAIWRSWPILCLQSQHRLLPSFCASTKAATMAASSLPPPTHHKKKDTVIVISGPTGAGKSRLALEVARRLGGEIISADSVQVYRGLDVGSAKPSAAEMSLVPHHLIDILDTSDDYSAGAFFRDARRATQDVLDRGCVPVIAGGTGLYLRWYIYGKPNVPQSSMESTLAVWSELADFRENGQWEEAVELVVQAGDPRARDLSVNNWNRLSRSLEIIRSSGSPPSAFALPYDAFCEQHDTDLTEAPSSAGNYEAREMEYDFFCIFLASPRIELYRSIDLRCEEMLVDTGGLLSEASWLLDIGLQPRMNSASSAIGYKQAMEYLLHCRQNGGESTPQEFLDFLAKFQRTSRNFAKRQLTWFRNEKIYHWVDGSKPFEALVQFVCDAYHGCSARMVPESLEMKRENCVLKSRDLKTYRSMNRVFLGGDDCSHVLNWIRRTQSK

SEQ ID NO: 678 - protein, 236 aa, Agrobacterium vitis S4
MEAHLIFGPTSTGKTSVAIALAKRTGFPVIVLDRIQCYSQLSVGGGRPSAAEFQGTRRIYLIEGSLDEGVISAERAHECLVAAVEAHKPEGGVILEGGSISLFKRMAQSSYWNCGFTWHVTRLHLGGEEIFLAAAKKRINQMMQPDEQGNSFLGELVSVWKTTALRATLEGICGYRYAIEFAGKQGLEMDALTSLNRRQLEQLVHGMAHEYLCYARQQEQELPLPSLAGGEGPPFQ

SEQ ID NO: 679 - DNA, 1156 bp, Glycine max
accaggccgcgtctttgatactgacggtatagttttaaaagaagaaaaaaatgaacatctcaacatcagcctgcgcctgcgcctgcgcctgcaaacaggagctgcccctagtaagcttccaaaagggatcacttatgatggagtcgttgtttcatcatcggaataacagcaacaaggataaggtagtggtgataatgggggccactggtgccggcaagacgaagttggctatagacgtggccaaacacttccaaccagcggagatagtgaactcagacaaaatgcaagtgtacaagggcctagacatcaccaccaataaggtcactgaagaagagtgtggcggggtcccacatcatctgcttggcactgttgacccatatataaatttcagcgccaacgacttctgtcgctacgccactttggccatcgactccattgtagaaaaaaatggcttacccatcatcgctggaggctctaattcttatttagacgcgttggtcaatcattatcctgagtttaggttaaggtaccagtgctgtttcctctgggtcgacgtggcactccccgttctccattcctccctccaggcacgtgtggaccgcatgatcgaagccggtcaagtcaacgatgttcgtgacttcttcgacccgagcgtaaccgattacaccaaagggatacgaagggctattggggtgcccgaattcgacgattttcttcgcgcagaggcgaatgggcggctagatgagagaacaaaacagaggcttcttcaggctgccattgcaaggttgaagatcaacaactgcacgctcgccaaccgccagattcagaagatccaccgcctgcacgccttctggaaacggaacatgcaccgcctcgacgccaccgaggttttccgcggctcacgtgacgcctggcgcgatcacgtgctcgccaagaccttgatcatcctccacaagtttctctacggagagaagaaaacgccgcacgttgtccccgccggaatcgtctccgccaaagacgtaattgcggcggcggcggtgctttcttcgccgccggtagcaatggcagcaacgcggtagaaagagaaagagtagtagggccagagaatctatatacaccattggcgcatgctgaaacactatatgccattgcatat

SEQ ID NO: 680 - DNA, 2236 bp, Zea mays
tttcttttagagtagaaatttagagttatatgagtgcggatagcctaacgcccgaggcgccgacggctgctccctggccgtcctcggaagcgcggcggccaggcgctgaggcgcaccacgccacgccggcggtgggacggaggagaggccggaagttgctggctcaaggtaagcggaatggcttccgttcccccactcctcccctccttgtagcttgcgagagcaaccttgtcggagctcgccgccgcagccacagccacaagtacgcatcctccgtttgaattcacatacagttctccatgggtacttcttcctgcacattcacactcaccacttccttgttgctaacgatggctaaataaggctaccactctatgactccgagccaagccaggagcaatggctctcgactgagtcctacctaggtgtatgatgaaatgcctgcaggacttcaaacgctgtcaagcagcattttcatctcagcaaatcacgtagcctaccctgaatttctgtctgcgtctttggcagatactcttcctttatcatgtccggcgagatgaggccacagcagctgggggcgatgcggcgtgccatctggaggagctggcctatcctgtgcttgcagtcacagcacaggcttctaccatctttctgtgcctcaaccaaggccgccacgatggccgcctcgtctctgccaccaccaactcatcataagaagaaggacacggtcatcgtcatctctggtcctactggtgctggaaagagcaggctggcgctggaggtggccaggaggctcggaggggagatcatcagtgcggactccgtgcaagtctaccgtggccttgacgttggttctgccaaaccgtccgcggcggagatgagcctagtgccgcatcacttgatcgacatactggacacgtccgacgattactcggctggagcctttttccgcgatgcccggagggcgacgcaggatgttcttgacagaggctgcgtgcccgttatcgcaggagggactgggctgtacctgagatggtacatctatggcaagccgaacgttccacagtcatccatggagtccactttggccgtgtggtctgagctcgctgattttcgggagaacggccagtgggaggaagcggtagagctggtggtgcaggctggtgaccccagagcccgggacttgtctgtcaataactggaacagattgagccgcagcctcgagattatcaggtcatcaggctcccctccttctgccttcgccttaccgtacgatgcattctgtgaacagcatgacactgacctaactgaggctccctcatccgctggaaactacgaggccagggagatggagtatgacttcttctgcattttcctcgcaagtccacgcattgaactgtaccggtcaattgatctgaggtgtgaagaaatgctggttgacacaggcggcttactttcggaagcctcatggctgcttgatatcgggttgcagccacgtatgaactctgcaagtagtgccatcggttacaagcaagccatggagtacctgctgcactgtaggcagaacggaggcgaaagcaccccacaagagttccttgacttccttgccaagtttcagaggacatctaggaacttcgcaaagaggcaacttacctggttccgcaatgagaagatttaccactgggtcgatggctcgaaaccatttgaggcacttgttcaatttgtctgtgatgcttaccatggctgcagtgcaaggatggttcctgaatcacttgaaatgaaaagggaaaattgcgtgctcaaaagccgtgatctcaaaacctatcgctcaatgaacagggtgtttcttgggggtgatgactgctctcacgttttgaattggatcaggagaacacagagcaaatgaaatatagatctactcccttatcatgtttttttcaaacatggaaattgtctagctttttggtgttgaccaattaggacaggagtttagtagatcaagacgcaaataacacatgaatttagtttataggtttttattctgttttctatcatagtgaaaatgccttttcaaagtgccacaatggaacgaaaagtcaggtttctcctttgacatctctccattttgagctttgtaagaagctcggttcctgttttcttaaggcaggtttcttctttgggcatctccctctttgagctttacgtaaatagtagtacctgattttgtaatatctta

SEQ ID NO: 681 - DNA, 711 bp, Agrobacterium vitis S4
atggaagcacacttgatcttcgggccgacatctacgggaaaaacttcagttgcaatagctcttgctaaaagaactggttttcctgtgatagtactggaccgaatccaatgctactcccagctttctgttggaggtgggcgaccttctgctgcagaatttcaaggaaccaggcgtatttacctgattgaaggatcgcttgatgaaggtgtaatcagcgctgaacgagctcatgaatgtctcgtcgcagcagtcgaagctcacaagcccgagggtggggtgatacttgaggggggctcaatctcactgttcaaacgtatggctcaaagcagctattggaattgtggctttacatggcatgtcacccgacttcacctcggcggtgaagagatttttctggcagcggcgaagaagaggatcaatcagatgatgcaaccggatgagcagggaaattcatttttgggagaactggtctctgtctggaagacaactgcgctgagagccacacttgagggaatatgtggctatcgttatgctatagaatttgctgggaagcagggtctggagatggatgcacttacaagcctgaaccgtcgtcaacttgagcagttggtgcacggtatggcgcatgaatatctctgctacgcccgtcaacaggaacaagaacttcccttgccctcgcttgctggtggggagggacctccatttcagtag

SEQ ID NO: 682 - DNA, 906 bp, Agrobacterium tumefaciens
gtgacaaattgctttcaaggagacagccatgccccacactttgttgaaaaacaagttgccttttgggaagaacctaaagccacttgctcttcaaggaggaatatcgaggaagagaatataacagcctctggtacagacttctcttgtgcaaaaaaatcaatttgtattcaacatatcgcaagaccgatggatctacgtctaattttcggtccaacttgcacaggaaagacatcgactgcgatagctcttgcccagcagactggcctcccagtcctctcgctcgatcgcgtccaatgctgtcctcaactatcaaccggaagcgggcgaccaacagtggaagaactgaaaggaacgactcgtctgtaccttgatgatcgccctttggtaaagggtatcattacagccaagcaagctcatgaacggctcattgcggaggtgcacaatcacgaggccaaaggcgggcttattcttgagggaggatctatctcgttgctcaggtgcatggcgcaaagtcgttattggaacgcggattttcgttggcatattattcgcaacgagttagcagacgaggagagcttcatgagcgtggccaagaccagagttaagcagatgttacgcccctctgcaggtctttctattatccaagagttggttcaactttggagggagcctcggctgaggcccatactggaagggatcgatggatatcgatatgccctgctatttgctacccagaaccagatcacgcccgatatgctattgcagctcgacgcagatatggagaataaattgattcacggtatcgctcaggagtttctaatccatgcgcgtcgacaggaacagaaattccctttggtgggcgcgacagctgtcgaagcgtttgaaggaccaccatttcgaatgtga

SEQ ID NO: 683 - DNA, 723 bp, Agrobacterium tumefaciens
atggatctgcgtctaattttcggtccaacttgcacaggaaagacgtcgaccgcggtagctcttgcccagcagactgggcttccagtcctttcgctcgatcgggtccaatgttgtcctcagctgtcaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattcttgagggaggatctatctcgttgctcaagtgcatggcgcaaagcagttattggagtgcggattttcgttggcatattattcgccacgagttagcagacgaggagaccttcatgaacgtggccaaggccagagttaagcagatgttacgccctgctgcaggcctttctattatccaagagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtatctcatccatgcacgccgacaagaacagaaattccctcgagttaacgcagccgcttacgacggattcgaaggtcatccattcggaatgtattag

SEQ ID NO: 684 - DNA, 923 bp, Agrobacterium tumefaciens
ggtgtgccttcgttagtgacaaattgctttcaaggagacagccatgccccacactttgttgaaaaacaagttgccttttgggatacggtaaagccagttgcacttcaataatgaatttcaaggagacaatataaccgcctctgataacacaattctctaatataaaaatcagtttgtattcaatatactgcaaaaaacttatggacctgcatctaattttcggtccaacttgcacaggaaagacgacgaccgcgatagctcttgcccagcagacagggcttccagtcctttcgcttgatcgggtccaatgctgtcctcaactatcaaccggaagcggacgaccaacagtggaagaactgaaaggaacgacgcgtctctaccttgatgatcggcctctggtggagggtatcatcgcagccaagcaagctcatcataggctgatcgaggaggtgtataatcatgaggccaacggcgggcttattcttgagggaggatccacctcgttgctcaactgcatggcgcgaaacagctattggagtgcagattttcgttggcatattattcgccacaagttacccgaccaagagaccttcatgaaagcggccaaggccagagttaagcagatgttgcaccccgctgcaggccattctattattcaagagttggtttatctttggaatgaacctcggctgaggcccattctgaaagagatcgatggatatcgatatgccatgttgtttgctagccagaaccagatcacggcagatatgctattgcagcttgacgcaaatatggaaggtaagttgattaatgggatcgctcaggagtatttcatccatgcgcgccaacaggaacagaaattcccccaagttaacgcagccgctttcgacggattcgaaggtcatccgttcggaatgtattag

SEQ ID NO: 685 - DNA, 723 bp, Agrobacterium tumefaciens; identical to SEQ ID NO: 683

SEQ ID NO: 686 - DNA, 3000 bp, Arabidopsis thaliana
ttattgggttatcacttacaattacaatagatacatttattaccaaatcccacttcatattaattaattatgcaaaatatattgttgaacaaccattgttatatataccacaacaactagagctcataatacctctaaatttattactattactatccctaataatgggaagtaatgagggtcaagaaacacatgtcctaatggtagcattagcattccaaggtcatctcaatccaatgctcaaattcgcaaaacatctcgcacgaaccaatctacacttcactctcgccaccactgagcaagcccgtgacctcctctcttccaccgctgacgaacctcatagaccggtggacctcgctttcttctcagacggtctacctaaagacgatccaagagatcccgacactctcgcaaagtcattgaaaaaagatggagccaagaacttgtcaaaaatcatcgaagaaaagagatttgattgcatcatctctgtgccttttactccctgggttccagctgttgcagctgcacataacattccttgtgcaatcctctggatccaagcttgtggagctttttctgtttattaccgttattacatgaagacaaatcctttccccgaccttgaagatctgaatcaaacagtggagttaccagctttaccattgttggaagtccgagatctcccgtcattgatgttaccttctcaaggagctaatgtcaataccctaatggcggaatttgcagattgtttgaaagatgtgaaatgggttttggttaactcgttttacgaactcgaatcagagatcatcgagtctatgtctgatttaaaacctataatcccaattggtcctcttgtttctccattcctgttgggaaatgatgaagaaaaaaccctagatatgtggaaagttgatgattattgtatggagtggcttgacaagcaagctaggtcttcagttgtttacatatctttcggaagcatactcaaatcattggagaatcaagttgagaccatagcaacggcattaaaaaacagaggagttccatttctttgggtgatacggccgaaggagaaaggcgaaaacgtccaggttttgcaggagatggttaaagaaggtaaaggggttgtaactgaatggggtcaacaagaaaagatattgagccacatggcgatttcttgcttcatcacgcattgtggatggaactcgacgatcgagacggtggtgactggtgttcccgtggtggcgtatccgacttggatagatcagccgcttgatgcgagactgcttgtggatgtgtttggaatcggagtaaggatgaagaacgacgctatcgatggagagcttaaggttgcagaggtggagagatgcattgaggccgtgacagagggacctgccgccgcggatatgaggaggagagcgacggagctgaagcacgccgcaagatcggcgatgtcacctggtggatcttccgctcagaatttagactcgttcattagtgatatcccaatcacttgaatttttgttgtttttcaatttgtaactctgtttctgttttagaattagttatctttagactgagcactttaacttgaaattactatagggccggtccaatgcttctaaagttttctaaatgttccatgcacaactaaaaaatgtgctcttttgtaacatatgaaaaccctaataagaaaagtttaatagtacaataaaatcgatcaacctcataacacaacacatcatcactattcacaggtgatggtagaccttttttatgttgatcaaaagaccatgtccttagctatttagctactatcaatcaagttctaatgtaaagagatatttggtgctatttaatctttagtgctgacacctgacatagttagagctgtcaattggacagacggtccatgggcttgcccagtccaaatgcatatggacgggctatattccggaccataaaacaaatggtccaattgggcatatgaccagttttgtccgcggataatatgggcttgaccatatggacaatgggctgcccatgggcatgaattgagggaaaaatacaattctccgattttacgattttgacggaaaaacgtaattccgcaaatttcctctaaaacgggattttattatattggcgagaacacaattttacagtttcgacgggaaaacgcaattctccgattttacggttttggcgggaaaacgcaatttttctgccaaaatcgtgattttattatattggcgaaaaacacaattttacagttttggtgagaaaacacaattctccgttttggcgggaaaaaacaattttacgattctaccgttttggcgggaaaaaacaatttcagaatttttccgccaaaatcgtgattttattgtattggtaagaaaaacacaattttaccgttttgtcggaaaaatgcaaaatgcaaaaacacaattctttaaaatcatgatttttaatttatcaataataaaatgggttatacatgggcttgcccatatggacatgatttttattggtcatggacatttttcggaccattgtccattatggaccgtccaacttggcccatagaaaaaactgtccatacgaacacgcccaatggtccctggacggaccatttgacagctatagacatagtccaaaagtaaagtaacaaaactagggtcttgagaagggcttataaaagaggagattttagagcataccaaaaacaattcagctttatctaattcttttttttttcttttttggaaaccatttctttgaccaaaataaaattgtaaaattttcagtattctatttctttgtcccaaccgaacatgcttcgtcacgactcgggatagaggagaagttgtcacatgacacatgttacctacatagaggccacgtattcaattctcttgcatcgctcagtattcttatctatatgaaatgtaaaaaggatgagctagtgagataaaaaaaaggaagagaaaacaaaaa

SEQ ID NO: 687 - DNA, 3000 bp, Arabidopsis thaliana
tgtaccacgtagtcctattaagaaatcggatcacgggtcgggtctattcgaacgccggttcttatccggtccgattgaaagcggtttggtttcagggaagaagaccaaggagaaagcaaaactgaagaaaagtggaagcaaatcctttacgaaaccaaaactgaagaaaagtgaaagcaaaatctttacattcaaaaacgttttcaccaacttatcttgttcgaagaagagtgtgattaagccaatcaacggtttcgattcattcgatggatcatcagatactgatcgttacatacctgagatcaactccttaagcacgattgtgagcagccatgagaaacctagaatcaaagaagaagaagataagactgagtctgctttagaggagccaaagatacaatgggcacaggggaaagcaggtgaagatcgagtacacgtcatcctctccgaggaaaacggttggcttttcgtcggaatttacgacggattcagcggtccagatccaccggattatcttatcaaaaatctctacactgccgtgctcagagagctcaaagggttactatggatcgacaaaggtgaatcatataatagaaacggcgagtccaacatcgagaaacagagtacagtcgagcatgcatccgattcggatcaagaaaactgccctgtgatgaatggaaacgatgttgcttgtggatcaagaaacattacgagtgacgtgaagaagttgcaatggaggtgcgagtgggagcataactcaagcaacaagtctaataatattaaccacaaagacgttcttagagctcttcaacaagcgttggagaaaacagaagaatcgtttgatctgatggttaatgagaatccagaattagccttgatgggatcctgcgttcttgtgacattgatgaaaggagaagatgtttacgtgatgagcgttggagatagccgagcggttcttgctcgaagacctaatgtcgagaaaatgaagatgcaaaaggagcttgagagagtcaaagaagaaagtccattagagaccttgttcatcaccgaaagaggactgagtcttctggtccctgttcagctcaataaggaacatagcacaagtgttgaagaggtgaatctttttgcgagtcctgattcagtgttttgttttgcgaacattagacactaacgatcttttgatgtgacaggaagtgagaagaatcaagaaggaacatcctgatgatatattagcgatagagaataatagagtgaaaggttatctcaaagtcactcgtgcatttggcgctggatttcttaaacaggtatatatatactcatgattttaatcagatagtttcaaaattttgcatgttttatagtttttagggttggattattaggtctacaaggtttgtagaaatatcaaaatgcagaaaaatactattacaaaacctggtttgtttttattcgatttgataatagttttgttcaatgtctttcctcagccaaaatggaacgaggcgcttctagagatgttcagaatagactacgtcggaacatcgccgtacatcacgtgctctccgtcgctacaccaccatagactctcatcacgtgacaaattcctaatcctctcatccgatggactatacgaatacttctcgaacgaggaagccatcttcgaggttgactcattcatctcagccttccctgaaggcgatcctgctcaacatctcattcaagaagtcctccttagagctgccaagaaatatggtaatactaagaacaaaacgcaaacgcacttaagattcgaaacgcaatctttgattaaactcacgtgcatttttttttttttttaggtatggactttcatgaattgctagagataccacaaggagatcgtcggaggtatcatgacgatgtttctgtgattgtgatttcacttgaaggaagaatttggagatcttccatgtgaatactaatcttttgaagagactcttactaaagtaacttttagaattgattcaatctttttagaatagattttttttttttttttttttggatttcgctgaggttttaccattttgttactcagcatattttaacgatgttgcatttgtgtcccatatacgttattgttagtgaaaaatataatgtaagaataatttatataactatcctactagcaaagctaacgcaaattttgaactcgaactttagttaccgtgaatgaaaataacagacttgaactttataatactcgtagtatacgtaatttttgctttttgcagatatgcttgccactaataaagtcataaattttatattttcataaactatagttatacacttttgactaaacaaacaaaatcggtttagcaaaagaaaaagttacttttctgatgaactaggataaggaattcggaactgaattttgctacgttctctctggaccacacacactgaacacccttttaagattttctccttctctttttcaacgtaatttatcttttgatcagaaacgacaaaaaagaagtctaacaatatcaaacaatttttttatagatatttttagatatttttcctgctaattttatctagtgtagacaaacccaaatatacgattattataaaaacacgaaataccaagtggacgactgaggttaatagatctagccgtagaataaagatctgcatgaaaggcggtgagaatctaaacggtgataagaccataacacacggaacatcggtacgctctcgaacgtacaagaatcgacgacacacaaacactccacaattatttgaacactggacaattattgaaccgacgtacgagaatcaatgcgctgagggtaaagacgtaaatgaagaactagttttggagataagagcggagaaagattgcgacacatgtatggtcaatattaatctcatttagcttataaatttgggagcttcctctatcattaattttcattcataaatttttcttcaatttgaattttctcgagaaaa

SEQ ID NO: 688 - DNA, 3000 bp, Arabidopsis thaliana
aaccaagttgtgatcaaacgtttcaaggatctaagacagaagataaagcatgtgattaatgagaacaagaacgagaaacaccgtatcactatggatgctgtgttggacaaagtacctcggaagtacggtttttcgaaagatttgagagacgatattttcgaacacttgaaaggaaactctgcagctaagaacaacaacaaagcagaaggtacaaaactgaagcaaataacaagagcttcgtcgctgtgtggttcgctggatagatatcttcagctctatgagtgtagcttccaaagagaagcgaagaacagtagtaattcagagaaatcaaagatggagttagaggaatcagcgttgccttctaagagagctcctaaattcttggggaggattctttcgttacctcaaatgaaatttcatgctttgaagattgatgaccttactgtccaatcaatagaggaagaacaagatggcttggacaacatttcagagatctcagaagatcactctcagtcttcagaacatgaaacacttgaccaaacaatggatgcttctgaggattcacccgttgatgcagaaacagaacaagacagagagatctctacgcttgacgttgaacatgaaacaagatcgttaaaagaatcatcagaagaaagtcctaataacgtttctacagttgatattgacgaaaatgcttctgtatttgatatctctcgaggtatgtatatatctttaacattcaatcatttctccatatcaaagttttccatcaaattgagaaagttattttttttttgttgctcagatttagatacagagactgtctcaacaagcaaacaattagatgaagaagtcctcaacatagatgcacaagataaagtgaaattcaactatgtaagagacattctcgagatctccggtttcaatgcaccagaatctctctcaatgtggcaattagattaccagccactggatccattagtctacgaagaagtgacaacgacaacaacaggatgtatgttccaagatccagaatgttcaagaaatgaagaagaaggcggtaactgcaaccacttgcttcttttcgatctaatcaacgaggtactaatcgaaatctacgaaaggtcttaccattattatcctaaaccgttatcatccctatgtaagatccatccaatgccggtggggtatagtgttttgaaagaggtttgggttagaataagctgttacttgcgttacaagccatacgacgaacaacaatcgtttgataaggttatgagtagggatttgtcgagagacgatggatggatggatttgcagttcgagagtgaatgtgttgggattgaagttgaggatttgatcttcgaggagcttctggaagaattgcttatatcatgttaataggcattcaagaactcgaatcatttcttcatttttcttctactttgttgctttgcttggagtttaaggtacataaaagagaaaatatggtgtttgtatgagtttttgttgttgtttatgataaaactttgtttaaaagaaattgtagaggataaatttttggaatatacaaaaatattttcaggtgattgatacattcatagtttatataatatggtatactatggtataataacattgtgctacaagattttaacaaaagcccgtctagctcagttggtagagcgcaaggctcttaaccttgtggtcgtgggttcgagccccacggtgggcgatactttttatgcgattttgagatttgtgtcttaaaatgtaatcgtgataatattaactacgcaactgttcatttcaattcttgtgaacgtgtaaacctcgaaactacacaaatcaaatcacgagatcctttccttttttcatatagatactcttttacttttttatagaattagacttatcgacactccatgatgattcccatatggatggttctcatatttttaacattactttttacatagatcgaatttttggaaatgtatcgaaaaaagaggagagattcgattcaaatacccacatagaacggacaaggtcaataatgggcccactattcttttgagagcccatctcaacaagttgaatcatcttttttgtgtactctcacttcaccttttgacaaaaagtcatggaagccaaactttggaacactactttactttgccaacatcttgttttgttgaatacctttttcaaattggaaaccaaagacatatctaaagggaaaacctgtaggacaataaaacaaagaagtgatagctaaagtctaaactaatctcaatatatgtaaatcaaagagataactaatgaaaaatatgaaaattttcgcgaggattaatgaacaaaggaatttttttttttccttctaaaattttttattagacaattggtattacaatgacaactacgaagctaatacaaaacttcggaaaccaacttattacataagcaaaattatgtgtcatatactgaaaattacgaaactgaaaaagtgaatttaacgatttttcctttcgataagctttattcgctaacatgttaacatgttagaacatagaaaatattgaaaaaaaatttatgtttaaattgtcaaatggaaatatactttacacttttatttgtattaattgttactttgctctcctagttataaagaagtaaagtctatgattttgttacttctttttttcttgtaaatctttatacatgtaaaaagcttttgtttccaactctaatcctcaatattttatttttctgtttattggaaaagggctgtaaactaaaattatttacttgaggaacgattatttaggtgataagagtggacaaagatcgttgacacgtggacggtctacaaattctaattttgcctataaatatcaaagctcctgaatatgtaagtttcattcactgattatcgtttaaggcaaattaagatcatcttcataaatcttctcagatctcttccaattttctagaaaaaac

SEQ ID NO: 689 - DNA, 3000 bp, Arabidopsis thaliana
ctaaattttcctaccatgtttgtttgtgttcctcaagtattcgtataatacgatgcaacatgtacatcgtaatgcattccacaataagccacaatctcatcttaatagcaaaaatgatggaaaggtttggccttttaatagcattccaaggagtaatagagagcaaatgccgcaggatcgtctatcttcactctggctatcttagatctccgattgcattgaatttttttgatctccagagcccatctctaatcaggtatagagatgggtttggaggaacaaggaagggcgagagaagacacacctcttcttggtaaaggaagaccattgtcgagcaagttcaagactttcgctaatgtcttcattgctatcgttggtgctggtgtccttggtcttccttacgccttcaaacgaaccggatggctcatgggtttgcttacgctcttttccgtcgctgctttgatcaaccattgcatgatgcttcttgttcatatccgtcgcaagcttggtgtctccaatatcggatcttttggggaccttggtttcgctgcctgcggcaatctcgggaggttcgtcgtcgacattcttattattttgtctcaggctgggttttgtgttggataccttatcttcatcggtaatactttagctaatctctctaagccaaccaagagtacgactttgatgagtctgaggcatttaatgggtgtgtctcctaagagtctctacatatggggatgttttccgtttcagctgggtttgaattctattaagacactcactcacttggctcctctgagcatatttgctgatgtggtcgatttgggtgcaatggcggtggtgattgtggaggacatcaagattacggtggtgcaaaggcctcaagttgtcgcctttggtggcatgtctgtgttcttctatggtatgggagtggctgtttacgcctttgaaggggttggaatggttttgcctcttgaatccgagactaaggataaggacaagtttggcaaagtgttggcactcagcatgctattcattgcagtgatgtatggatcttttggtgtgttaggctacatggcttttggggatgatacaatggatataatcacagctaacttaggggcaggagtggtgagcagtcttgtgcagctggggctctgtatcaaccttttcttcacctttcccttgatgatgaaccctgtgtttgagattgtggagagacgtttctggagtggaatgtactgcgtctggctcagatggctgctcgtcttggcagtgactttggtggctctcttggtgccaaactttgctgattttttgtcattggttggcagcagcgtctgttgtgcgttgggctttgtgttgccttctttgtttcatctgatggtcttcaaagacgaaatggagtggaagcaacgagctttagacgtggggatcctgctgctgggtgtcattcttggtgtctcaggtacttggagttctctgactgagatcttccaagagtaggtaggtgaaagaaattggacacattgtttcttttgttggaattaaggggaatgttataggccgttgcagcaacctttgtatgcaacacctccatgtgtcatctcctaaagtcaagaaaacattaaaaaaacaaggaaactagcaaaatgagaacaaacttgtaccaattttcagatgttcagaaaatattcaactcacttcggctgctattctttgaatccagttttcagttataagctttaacctatgtaataaatggctccacaacaaaatgcaaaacgaaatattcatagtatctcaaaatagttttttttggtgacttctaaaatcacacaactttcagaagaagaataacgaaacataaattatagaggaggagcatcactactattttcattttttcagccaatcacagcgctcctctgtacgcccactcgcacctacttcacgtcacgcgctcaattctatacccattcgcaccaacttcgcgttgagcgcgtgtcatcaatttctgtaggggtaaacccacaaaatcatgcctatttctattctactcgctttgattccaaaagaggctcgcgtgatcccaaaacctttttttcttttgttttttctgaaaaccatattaattctaatgcaaaccaaacccaaatcaattttcatttcaaaaccatgtaaaccgaaccgaaatcataacaccaaaaagacaacctagcaatatactcatatatcgtcaatttcactattaatccaacgagccagtttattgcgatgacgtttctaatgcttcctaatgacatgcttttaactatttagcccgcgtcttgattgtagtatcctactctttccttagtttccaagagattccgcgctatccttgcttctcttgagctttacgaaacccgaactctcttaggctgccccgagagtcgtctttatgtatatttgagtttccttcatgactctaattaccgatcatgtctgttcactctctgccggagaccgagtcgactcactgttggtaagttggtaaccctaaccctagatggttcacgtcatgctttagaccatgtaaactcctaacaaagataaagtcagatgagaacaatcttttggtttcagacccaactcgtaattttccttatatgagttggtcggatccggatctaaccacacttcgttacatacttacacccccaagttaggattaatggatgcacttgacttgggggaattttttctactttcaatgaaagcaagtgtcaacgtgttggaatgttgttatgttaaaagtaataaccattgagcatgtgtcaagtgttttgattctgtatccctggaacaagcacgctcttgttgggcttgataatatttttcaactagaaaatttattgataaaccaaacaacgactcttgggatgatgttgttggttacgtagcacgtttgaattcaggatgctttgtcacgactgaggtaagaggagaaggagccac

SEQ ID NO: 690 - DNA, 3000 bp, Arabidopsis thaliana
gagccatcggagagattaaaattggagaatatatgtgttgactagtttattccagtagatggacaaattgaattgtcttggagaagtggctcaactattgtccaatgaaatagtttaacgatttattgtagtcaattttcttttttatatgattatgcaaaatgcgaggagtattttagtcaaaacgtgaaaatatgtatagccttttaaattatggttttcgttagagaggagacatatacacatacaaacgcaaaagaatacatatactatttatgatttaggttacaaataaaaacattacacagcaggaacaagtcaagcaagcttaatagttactcttactcattacgcaacacaatgccaagtctttattccaacatacacaaagatctcttagcataaaacacatttttttcccattttccttggtttgagaccatgctgataatttcttcaacagttacagcttgacccgcagctgcagtttgatccacagctacagttatcacactccttgttgtagttcttctcgcaactttgtcataccaaaaaaacaacagaagtataagatttcaaaaatttatcttaaggaatatgtaaccacatgtatattagatatatatgcatgataagttaatgaagagagaatctagggtttacctgcacgaatcaccacatttgcaggaggagccacatccacagttagaacctgccatttctcttacttctctttgattgattttgtagttttctttttcttcttctgatgctttatgtgatttcaactaagggaatggccagtatatatagaagaatataaaatatcggttttatatccaccatacatttcctatatatatatattatcttttgtcaacctccctatatatattttatattttcctgtaagttttagtttcgtatatgatagggttagcaaagtttttgtatatgagatatacatatagctttcttgttggactatataatccctctagatatagattttctaatttcggcagattttgagtaaatatccaaaaaaatctcactatcttgacaagattacaaaataatcttttaatttaactatttaagacaacatgtataaaacctatatcttaactaaaaactctatattattgcaactatataatctaaatgtctattatcttaaataaataaaaatgccactaccactttttgatattataggccaagttattgatcagtaaaacgaggccggcacgtaggaactaggaagtcaaaaaataatatttttgtgatggaacgtaaattcaccaattcaggaccttgaaggggcaagaagccaactaaaacaccagccccaaccctagtgcaaattaccattctatataatgaccccatctacgatttattccttctatttccctttacgtaaagtagcgacgttcgtgaattcctaagaagttagactaacaggtttgtgtggttcttaaatttttgggtaaaaattaggaaaaaagtttatattcctacccaaactttcggcaccagagacaaattaggtttgttcagaaaatcagtcgctcatcgacagacttaacaccacaaaatcatcagaatttctttgggacaaaatggaaaatgttcttcacggctccacctaccaaaatttcgatatcaagctcaaaagcatacacaaactataactaattccatagttacgtaatcttaacttcgaattcaacaacacatgcatgcatcgactgaatcttcaacaaatgcaatcaaacacacaaaattgctaccaaaaaaatatgattttttttttatgatttcaattttcatccggcacttagtccaaaactttttttgtgtgtcaacattttttaaaaaaatctttaaacggatatctgatctaagagcatgttcataggtgatacttacaaaatatttttaagaaattttttagtattatttataatgtttgtttaataaatatatataagattttttgcttttatcaaatgtgaccaatcagaagaaaccacgtcagatgatactgatatgacaaatatgatactgatcaaacatattctaattgctttactaatataaaaataatttttggacttgtgatactctaaaaatatcacccatatacatggtctaatatatggatcgtaaaaaactcatatataatattaataagtagtagaagagcgtagaccatgtcctgggtcgtcgtccaaatgaccacaagaagatttcaaaacagaggaaaatatttctcattaaataagttttcctgacgcataagataacattattacaagattcagaaaaagaaaggtgaaaggataatgtttctcctactatataagatgtgtacatctgaaaaaatatgaatatatttgtaacgtttgactgttattacatgattaatacgatataaatattaacattttttttcaaaataaaagtaatatagtaaggaaatgaaaagaggcatgaagcatgcctctttttttggtcggctgccgtttacaattgccaattgcgatagttactcttcttgcgtgtacgacttttgtttttttttacatattcgccaataatttgacgttttctattagtttgtttgatactctgttgtcttgctaaaactcaataaaacattaaattactttcttgaatgaagctggaacaaatctaacataaatagaaaatgatgggcaagttgatgttattcgtaaatttatttagattatattatataaaaagcaatccaattatatatctcatatatacaatttcttatcttactttgtcaatgtcatatacgtaactaaaacttgcggaaatagaaaatgccacgtgtatggtggacataatccgaatctctctctttcttctataaatagtggccattcccattggttgaaatcacaaaagcatcataagaagaagaagaaactacaatagttaatcaatcaaagagaagtaagagaa

SEQ ID NO: 691 - DNA, 3000 bp, Arabidopsis thaliana
agacttgacatcacattacataacaaaaacaagtctataacaactttaacagtcaatttctagtgatcagaaacatgaaacgttagaaagtgatcgccgaaacgaatgacgatccttcaaagagaacatacacaaataaaaaacataatgcaagtgagccaacaaaacaaaagaccccaatcacacatcagcaaaatcaacgatgatgactcactaaaaccaataaatcaacaaagacctcaaaacccagattgatgatcacacaatcacacaatccccaaaatcaattttaacttcaaattaggtaaatcagtgaatttaagacacagttaaacagaattaccctctagagattaaaatccgatcaaattcaattcaattaggtaaagtaataacctttgttggcgttcgaattctcgagcaagaagcggcaggaggagtagcgatctccactacgttgggctccattgaacgatcccaaactcaaagaactaaaaacggaaaacgagataattttccagaagaagaagaagaaatcgatcaaagaaaccttggcgccgtaatatataccaacacacagtgagattgcgcaaaggcttttctctcttaacacttaaaaccaattcctctttctctctattaatcctaaatcttaataaattaaagacctaaattaaaacagtgatgattaatgaaaattttccaatttgtgcgtttttattcaacaagtcaatacggaaagtctacgcatatggggcccactttttacattgacggttgcgattgaagtttatattggaaattattatttaacggtgatgatgaaggtactactagtactagtgtggtctgctgctgtagacgaaatagaccgagcttaaacaacaaggttaggtgatttcgaccaaggctatgattttagaaccgttcgatgtgagataaacaagttattgggttaatccaacggttgggaactatttttttggttccgttttttttttttatagtaacagaataatcatagcaaatctaatgagaagatataattgagttgttttttaagttataaagaatacactgatattttttctaaagaagtacgatgaatctgactagtatcattgattaaattataaatttattttaaataaaaagaccagtaaatgaatgatcaatcaatgtaaaaaaagatgtaatagtgctattatcaatgatcatcaatgttatagtgctattattatttgtgttttggcccattatcttattcttactttcagctattaatagattaagtttgttaataacaacaaaaaaaaagatgaagtttgtttagatatataaaaagaaaagttgaatacagtaagtaataaaaatgtattaatttaaatttaaaataattaaactggtgtgacatactgacatatgtcgttattgatttttttacaaaatttatctctttttttttgtttgaaaagagatttttttaaaaaaattagaaaagagatttttttaaaacaaaagaaaaaaggagagagagagagagatccatgctggtcttattttgggcctatgtacattatttcttatgttatgggcttttacaaatgggcatcatcagtaaaaataaacaaaagaaacaaacatgataacataacataagttaaaagaagaaaacaaacaaacaaaagaaacagtcgaactttttgatcgaaaaataaacatgagatagtcatcagtcatcacaggctttgtaatctactgtagttgaggataatgaagttgtttgttttattaagtcactaatttctgaaacatatgctctgctaattttcaaattagagaaccaaattaataaaagttgaaagagacagaaagccatctttttggtctttgcaagttagtggatagatttttattcacaaaacgacatgcatttctttgctcattcttcttgggacatattcgtcatttcgtgactgaaaaaatgatgtttatgtaagaaatgccgaggacattaatatttcagaattcagacaatgtacacaaacgcaagtgaatattataaggataatctaagtgaaagagtttaaaatggaacagaatggtttttagttatctacaatctttcctcaatgattaaaaaaaaatgatttcgatataatcttcttctttttcttttttggggaaacaagatatatcttacgaaacaaaaatagtcatgcatcaaataatgttagttctcccataaaatattgtatttgaacttagattagataaatcaacttttattcttctaatgattgtatttggattctattggaaataagcttaatcatcagtaggacactagtcatatttcatatttgggaaaaaggatatagagcactacattcaaatcatatccttttggaatctttgagtaatcatgagtttcgcaaagttaaaattaccccgaatcataggagtatagatttaaaattgatctattataaaaacaaagatcttgttcaaaactttaaatcttgttcacgagtacgtcacaattttgtctgggaggcaacgactttaaattgtcacctatgatttgaggagcacgcctctatttaaatatttcaactagattatttatactaatagtaattccaactacatatgctaaaattcatatattttgatttcagttgttaatcaactatattccaaatttgttatataaaaaaagagttgtaatggattactacaaaaaaagggaagaataacgaatatagtgggaaaaaaggagtgaaatggacacgagaggttggcaacgaaaggcttttctctccataacccaaaaaagattcggttgtcacataatttgcagagattctccactctctctatccttctataaattacatagccatcggatcacaaaacagaacaacaacaacaacaacaaacaagaactcaaacacttcataactaaacatcctttaaagccttttcaaaaactcaatc

SEQ ID NO: 692 - DNA, 1020 bp, Zea mays
ggcccataacagcatctcctccaccagtttattgtaagaataaattaagtagagatatttgtcgtcgggcagaagaaacttggacaagaagaagaagcaagctaggccaatttcttgccggcaagaggaagatagtggcctctagtttatatatcggcgtgatgatgatgctcctagctagaaatgagagaagaaaaacggacgcgtgtttggtgtgtgtcaatggcgtccatccttccatcagatcagaacgatgaaaaagtcaagcacggcatgcatagtatatgtatagcttgttttagtgtggctttgctgagacgaatgaaagcaacggcgggcatatttttcagtggctgtagctttcaggctgaaagagacgtggcatgcaataattcagggaattcgtcagccaattgaggtagctagtcaacttgtacattggtgcgagcaattttccgcactcaggagggctagtttgagagtccaaaaactataggagattaaagaggctaaaatcctctccttatttaattttaaataagtagtgtatttgtattttaactcctccaacccttccgattttatggctctcaaactagcattcagtctaatgcatgcatgcttggctagaggtcgtatggggttgttaatagcatagctagctacaagttaaccgggtcttttatatttaataaggacaggcaaagtattacttacaaataaagaataaagctaggacgaactcgtggattattactaaatcgaaatggacgtaatattccaggcaagaataattgttcgatcaggagacaagtggggcattggaccggttcttgcaagcaagagcctatggcgtggtgacacggcgcgttgcccatacatcatgcctccatcgatgatccatcctcacttgctataaaaagaggtgtccatggtgctcaagctcagccaagcaaataagacgacttgtttcattgattcttcaagagatcgagcttcttttgcaccacaaggtcgagg

SEQ ID NO: 693 - DNA, 1152 bp, Artificial sequence
  Arabidopsis thaliana derived metallothionein promoter
caggcggccgcgaattcactagtgatgacgatgtttctgtgattgtgatttcacttgaaggaagaatttggagatcttccatgtgaatactaatcttttgaagagactcttactaaagtaacttttagaattgattcaatctttttagaatagattttttttttttttttttggatttcgctgaggttttaccattttgttactcagcatattttaacgatgttgcatttgtgtcccaatatacgttattgttagtgaaaaatataatgtaagaataatttatataactatcctactagcaaagctaacgcaaattttgaactcgaactttagttaccgtgaatgaaaataacagacttgaactttataatactcgtagtatacgtaatttttgctttttgcagatatgcttgccactaataaagtcataaattttatattttcataaactatagttatacacttttgactaaacaaacaaaatcggtttagcaaaagaaaaagttacttttctgatgaactaggataaggaattcggaactgaattttgctacgttctctctggaccacacacactgaacacccttttaagattttctccttctctttttcaacgtaatttatcttttgatcagaaacgacaaaaaagaagtctaacaatatcaaacaatttttttatagatatttttagatatttttcctgctaattttatctagtgtagacaaacccaaatatacgattattataaaaacacgaaataccaagtggacgactgaggttaatagatctagccgtagaataaagatctgcatgaaaggcggtgagaatctaaacggtgataagaccataacacacggaacatcggtacgctctcgaacgtacaagaatcgacgacacacaaacactccacaattatttgaacactggacaattattgaaccgacgtacgagaatcaatgcgctgagggtaaagacgtaaatgaagaactagttttggagataagagcggagaaagattgcgacacatgtatggtcaatattaatctcatttagcttataaatttgggagcttcctctatcattaattttcattcataaatttttcttcaatttgaattttctcgagaaaaatatcgaattcccgcggccgc

SEQ ID NO: 694 - DNA, 819 bp, Artificial sequence
  IPT coding sequence
ttctctaatataaaaatcagtttgtattcaatatactgcaaaaaacttatggacctgcatctaattttcggtccaacttgcacaggaaagacgacgaccgcgatagctcttgcccagcagacagggcttccagtcctttcgcttgatcgggtccaatgctgtcctcaactatcaaccggaagcggacgaccaacagtggaagaactgaaaggaacgacgcgtctctaccttgatgatcggcctctggtggagggtatcatcgcagccaagcaagctcatcataggctgatcgaggaggtgtataatcatgaggccaacggcgggcttattcttgagggaggatccacctcgttgctcaactgcatggcgcgaaacagctattggagtgcagattttcgttggcatattattcgccacaagttacccgaccaagagaccttcatgaaagcggccaaggccagagttaagcagatgttgcaccccgctgcaggccattctattattcaagagttggtttatctttggaatgaacctcggctgaggcccattctgaaagagatcgatggatatcgatatgccatgttgtttgctagccagaaccagatcacggcagatatgctattgcagcttgacgcaaatatggaaggtaagttgattaatgggatcgctcaggagtatttcatccatgcgcgccaacaggaacagaaattcccccaagttaacgcagccgctttcgacggattcgaaggtcatccgttcggaatgtattaggttacgccagccctgcgtcgcacctgtcttcatctggataagatgttc

SEQ ID NO: 695 - DNA, 726 bp, Artificial sequence
  OCS terminator
actagtccctagagtcctgctttaatgagatatgcgagacgcctatgatcgcatgatatttgctttcaattctgttgtgcacgttgtaaaaaacctgagcatgtgtagctcagatccttaccgccggtttcggttcattctaatgaatatatcacccgttactatcgtatttttatgaataatattctccgttcaatttactgattgtaccctactacttatatgtacaatattaaaatgaaaacaatatattgtgctgaataggtttatagcgacatctatgatagagcgccacaataacaaacaattgcgttttattattacaaatccaattttaaaaaaagcggcagaaccggtcaaacctaaaagactgattacataaatcttattcaaatttcaaaagtgccccaggggctagtatctacgacacaccgagcggcgaactaataacgctcactgaagggaactccggttccccgccggcgcgcatgggtgagattccttgaagttgagtattggccgtccgctctaccgaaagttacgggcaccattcaacccggtccagcacggcggccgggtaaccgacttgctgccccgagaattatgcagcatttttttggtgtatgtgggccccaaatgaagtgcaggtcaaaccttgacagtgacgacaaatcgttgggcgggtccagggcgaattttgcgacaacatgtcgaggctcagcagga

SEQ ID NO: 696 - DNA, 685 bp, Artificial sequence
  mannopine synthase (mas) terminator
cagcttccctgaaaccttggactcccatgttggcaaaggcaaccaaacaaacaagaagatccgctcctgcatatggggcggtttgagtatttcaactgccatttgggctgaattgaagacatgctcctgtcagaaattccgtgatcttactcaatattcagtaatctcggccaatatcctaaatgtgcgtggctttatctgtctttgtattgtttcatcaattcatgtaacgtttgcttttcttatgaattttcaaataaattatcgatagtactacgaatatttcgtatcgctgatcttctcaatcacaatgatgcgtagtgacccgacaaataatttaagcgtccttaataccaatcctaaaataattgaggcaaataaaatttttttgtaatttttatgatagcagatcgattctccagcaagcctgcaacaaaatattgtgtatttctaaatagattttgatattaaaatcccgagaaagcaaaattgcatttaacaaaacagtaatttagtacattaataaaaattatgctcaaacatttccatgaaattaaaacataattacattttacaacacaatattttgcgatattattgcctttcgccaatttaacactggaagcaattaaagtaggcccacacagagcgctttgcaacactgacaacgcttgcggttggtcgg

What is claimed is:

1. A nucleic acid construct comprising a polynucleotide encoding adenosine phosphate-isopentenyltransferase (IPT) operably linked to a promoter consisting of the nucleic acid sequence of SEQ ID NO:693.

2. A host cell transformed with the nucleic acid construct of claim 1.

3. The host cell of claim 2, wherein said cell is a plant cell.

4. The host cell of claim 3, wherein said plant cell forms part of a plant.

5. A transgenic plant comprising the nucleic acid construct of claim 1.

6. A method of producing a transgenic plant, comprising expressing within the plant the nucleic acid construct of claim 1.

7. A method of increasing abiotic stress tolerance (ABST) of a plant, comprising expressing within the plant the nucleic acid construct of claim 1, thereby increasing the abiotic stress tolerance of the plant.

8. The method of claim 7, wherein said abiotic stress is selected from the group consisting of drought, cold stress, chilling stress, heat stress, salinity stress, osmotic stress, freeze stress, nutrient deficiency and heavy metal stress.

9. The method of claim 7, further comprising growing the plant under the abiotic stress.

10. The nucleic acid construct of claim 1, wherein said IPT is set forth by SEQ ID NO:694.

11. The nucleic acid construct of claim 1, wherein said nucleic acid construct comprises the nucleic acid sequence set forth by SEQ ID NO:1.

* * * * *